(12) United States Patent
Xu et al.

(10) Patent No.: US 10,731,173 B2
(45) Date of Patent: Aug. 4, 2020

(54) COMPOSITIONS AND METHODS FOR PRODUCING TOBACCO PLANTS AND PRODUCTS HAVING REDUCED OR ELIMINATED SUCKERS

(71) Applicant: ALTRIA CLIENT SERVICES LLC, Richmond, VA (US)

(72) Inventors: Dongmei Xu, Glen Allen, VA (US); Chengalrayan Kudithipudi, Midlothian, VA (US); Yanxin Shen, Glen Allen, VA (US); Jaemo Yang, Richmond, VA (US); Jesse Frederick, Richmond, VA (US); James Strickland, Richmond, VA (US)

(73) Assignee: Altria Client Services LLC, Richmond, VA (US)

( * ) Notice: Subject to any disclaimer, the term of this patent is extended or adjusted under 35 U.S.C. 154(b) by 385 days.

(21) Appl. No.: 15/457,553

(22) Filed: Mar. 13, 2017

(65) Prior Publication Data
US 2017/0260535 A1 Sep. 14, 2017

Related U.S. Application Data

(60) Provisional application No. 62/307,035, filed on Mar. 11, 2016, provisional application No. 62/399,181, filed on Sep. 23, 2016.

(51) Int. Cl.
| | | |
|---|---|---|
| *C12N 15/82* | (2006.01) | |
| *C07K 14/415* | (2006.01) | |
| *A24B 13/00* | (2006.01) | |
| *A24B 15/10* | (2006.01) | |

(52) U.S. Cl.
CPC .......... *C12N 15/8261* (2013.01); *A24B 13/00* (2013.01); *A24B 15/10* (2013.01); *C07K 14/415* (2013.01); *C12N 15/827* (2013.01); *Y02A 40/146* (2018.01)

(58) Field of Classification Search
None
See application file for complete search history.

(56) References Cited

U.S. PATENT DOCUMENTS

| | | |
|---|---|---|
| 4,091,823 A | 5/1978 | Kallianos et al. |
| 4,516,590 A | 5/1985 | Teng |
| 4,528,993 A | 7/1985 | Sensabaugh, Jr. et al. |
| 4,638,816 A | 1/1987 | Cox et al. |
| 4,660,577 A | 4/1987 | Sensabaugh, Jr. et al. |
| 4,732,856 A | 3/1988 | Fedoroff |
| 4,762,785 A | 9/1988 | Comai |
| 4,778,987 A | 10/1988 | Saaski et al. |
| 4,848,373 A | 7/1989 | Lenkey |
| 4,945,050 A | 7/1990 | Sanford et al. |
| 4,987,907 A | 1/1991 | Townsend |
| 5,004,863 A | 4/1991 | Umbeck |
| 5,013,658 A | 5/1991 | Dooner et al. |
| 5,085,325 A | 2/1992 | Jones et al. |
| 5,104,310 A | 4/1992 | Saltin |
| 5,141,131 A | 8/1992 | Miller, Jr. et al. |
| 5,149,645 A | 9/1992 | Hoekema et al. |
| 5,159,135 A | 10/1992 | Umbeck |
| 5,177,010 A | 1/1993 | Goldman et al. |
| 5,231,019 A | 7/1993 | Paszkowski et al. |
| 5,316,931 A | 5/1994 | Donson et al. |
| 5,372,149 A | 12/1994 | Roth et al. |
| 5,463,174 A | 10/1995 | Maloney et al. |
| 5,464,763 A | 11/1995 | Schilperoort et al. |
| 5,469,976 A | 11/1995 | Burchell |
| 5,491,081 A | 2/1996 | Webb |
| 5,563,055 A | 10/1996 | Townsend et al. |
| 5,565,350 A | 10/1996 | Kmiec |
| 5,589,367 A | 12/1996 | Donson et al. |
| 5,659,026 A | 8/1997 | Baszczynski et al. |
| 5,689,035 A | 11/1997 | Webb |
| 5,731,181 A | 3/1998 | Kmiec |
| 5,756,325 A | 5/1998 | Kmiec |
| 5,760,012 A | 6/1998 | Kmiec et al. |
| 5,789,156 A | 8/1998 | Bujard et al. |
| 5,795,972 A | 8/1998 | Kmiec |
| 5,814,618 A | 9/1998 | Bujard et al. |
| 5,866,785 A | 2/1999 | Donson et al. |
| 5,871,984 A | 2/1999 | Kmiec |
| 5,879,918 A | 3/1999 | Tomes et al. |
| 5,886,244 A | 3/1999 | Tomes et al. |
| 5,889,190 A | 3/1999 | Donson et al. |
| 5,889,191 A | 3/1999 | Turpen |
| 5,932,782 A | 8/1999 | Bidney |
| 5,981,840 A | 11/1999 | Zhao et al. |
| 6,072,050 A | 6/2000 | Bowen et al. |
| 8,124,851 B2 | 2/2012 | Dewey et al. |
| 8,319,011 B2 | 11/2012 | Xu et al. |
| 9,187,759 B2 | 11/2015 | Dewey et al. |
| 9,228,194 B2 | 1/2016 | Dewey et al. |
| 9,228,195 B2 | 1/2016 | Dewey et al. |
| 9,247,706 B2 | 2/2016 | Dewey et al. |

(Continued)

FOREIGN PATENT DOCUMENTS

| | | |
|---|---|---|
| EP | 0821866 | 2/1998 |
| WO | WO 98/49350 | 11/1998 |

(Continued)

OTHER PUBLICATIONS

Lu et al (2013, "Cotton GhMKK1 Induces the Tolerance of Salt and Drought Stress, and Mediates Defense Responses to Pathogen Infection in Transgenic Nicotiana benthamiana", PLOS One 8(7): e68503, (pp. 1-14)).*

(Continued)

*Primary Examiner* — Stuart F Baum
(74) *Attorney, Agent, or Firm* — Arnold & Porter Kaye Scholer

(57) ABSTRACT

The present disclosure provides the identification of genes involved in sucker growth in tobacco. Also provided are promoters that are preferentially active in tobacco axillary buds. Also provided are modified tobacco plants comprising reduced or no sucker growth. Also provided are methods and compositions for producing modified tobacco plants comprising reduced or no sucker growth.

20 Claims, 26 Drawing Sheets

Specification includes a Sequence Listing.

(56) References Cited

U.S. PATENT DOCUMENTS

| | | |
|---|---|---|
| 2002/0008055 A1 | 1/2002 | Campbell et al. |
| 2004/0118422 A1 | 6/2004 | Lundin et al. |
| 2005/0057263 A1 | 3/2005 | Moshe et al. |
| 2005/0178398 A1 | 8/2005 | Breslin et al. |
| 2006/0191548 A1 | 8/2006 | Strickland et al. |
| 2006/0200878 A1 | 9/2006 | Lutfiyya et al. |
| 2016/0281100 A1 | 9/2016 | Kudithipudi et al. |

FOREIGN PATENT DOCUMENTS

| | | |
|---|---|---|
| WO | WO 99/07865 | 2/1999 |
| WO | WO 0058035 | 10/2000 |
| WO | WO 2004/041006 | 5/2004 |
| WO | WO 2008/133643 | 11/2008 |
| WO | WO 2011/027315 | 3/2011 |

OTHER PUBLICATIONS

Bowie et al, (1990, "Deciphering the Message in Protein Sequences: Tolerance to Amino Acid Substitutions", Science 247:1306-1310).*
McConnell et al, (2001, "Radial Patterning of Arabidopsis Shoots by Class III HD-ZIP and KANADI Genes", Nature 411 (6838):709-713).*
Benfey et al (1990, "The Cauliflower Mosaic Virus 35S Promoter: Combinatorial Regulation of Transcription in Plants", Science 250: 959-966).*
Benfey et al (1989, "The CaMV 35S Enhancer Contains At Least Two Domains Which Can Confer Different Developmental and Tissue-Specific Patterns", EMBO J, 8(8):2195-2202).*
Wu et al (2015, "LcMKK, a Novel Group A Mitogen-Activated Protein Kinase Kinase Gene in Lycium chinense. Confers Dehydration and Drought Tolerance in Transgenic Tobacco Via Scavenging ROS and Modulating Expression of Stress-Responsive Genes", Plant Growth Regulation 76:269-279).*
Akaba et al., "Production of Homo- and Hetero-Dimeric Isozymes from Two Aldehyde Oxidase Genes of *Arabidopsis thaliana,*" *The Journal of Biochemistry*, 126:395-401 (1999).
Allen et al., "Evolution of microRNA genes by inverted duplication of target gene sequences in *Arabidopsis thaliana,*" *Nature Genetics*, 36:1282-1290 (2004).
Allen et al., "microRNA-directed phasing during trans-acting siRNA biogenesis in plants," *Cell*, 121:207-221 (2005).
Altschul et al., "Basic local alignment search tool," *Journal of Molecular Biology*, 215:403-410 (1990).
Altschul et al., "Gapped BLAST and PSI-BLAST: a new generation of protein database search programs," *Nucleic Acids Research*, 25:3389-3402 (1997).
Amaya et al., "Expression of Centroradialis (CEN) and CEN-like genes in tobacco reveals a conserved mechanism controlling phase change in diverse species," Plant Cell, 11:1405-1418 (1999).
Avci et al., "Cysteine proteases XCP1 and XCP2 aid micro-autolysis within the intact central vacuole during xylogenesis in *Arabidopsis* roots," *Plant Journal*, 56:303-315 (2008).
Axtell et al., "A two-hit trigger for siRNA biogenesis in plants," *Cell*, 127:565-577 (2006).
Bartel, "MicroRNAs: genomics, biogenesis, mechanism, and function," *Cell*, 116:281-297 (2004).
Beetham et al., "A tool for functional plant genomics: Chimeric RNA/DNA oligonucleotides cause in vivo gene-specific mutations," *Proceedings of the National Academy of Sciences USA*, 96:8774-8778 (1999).
Bender et al., "Pseudomonas syringae phytotoxins: Mode of Action, Regulation, and Biosynthesis by Peptide and Polyketide Synthetases," *Microbiology and Molecular Biology Reviews*, 63:266-292 (1999).
Bowman et al., "Revised North Carolina grade index for flue-cured tobacco," *Tobacco Science*, 32:39-40 (1988).
Canevascini et al., "Tissue-specific expression and promoter analysis of the tobacco LTP1 gene," *Plant Physiology*, 112:513-524 (1996).

Cermak et al., "Efficient design and assembly of custom TALEN and other TAL effector-based constructs for DNA targeting," Nucleic Acids Research, 39:e82 (2011).
Cheng et al., Auxin Synthesized by the YUCCA Flavin Monooxygenases Is Essential for Embryogenesis and Leaf Formation in *Arabidopsis*, *Plant Cell*, 19:2430-3439 (2007).
Christensen et al., "Sequence analysis and transcriptional regulation by heat shock of polyubiquitin transcripts from maize," *Plant Molecular Biology*, 12:619-632 (1989).
Christensen et al., "Maize polyubiquitin genes: structure, thermal perturbation of expression and transcript splicing, and promoter activity following transfer to protoplasts by electroporation," *Plant Molecular Biology*, 18:675-689 (1992).
Christou et al., "Stable Transformations of Soybean Callus by DNA-Coated Gold Particles," *Plant Physiology*, 87:671-674 (1988).
Crone et al., "The differential expression of a heat shock promoter in floral and reproductive tissues," *Plant, Cell and Environment*, 24:869-874 (2001).
Crossway et al., "Micromanipulation techniques in plant manipulation," *Biotechniques*, 4:320-334 (1986).
De Jong et al., "Chemical-induced apoptotic cell death in tomato cells: involvement of caspase-like proteases," *Planta*, 211:656-662, (2000).
Devarenne et al., "Adi3 is a Pdk1-interacting AGC kinase that negatively regulates plant cell death," *EMBO Journal*, 25:255-265 (2006).
De Wet et al., "Exogenous gene transfer in maize (*Zea mays*) using DNA-treated pollen," *The Experimental Manipulation of Ovule Tissues*, 197-209 (1985).
D'Halluin et al., "Transgenic Maize Plants by Tissue Electroporation," *The Plant Cell*, 4:1495-1505 (1992).
Doyle et al., "TAL effector-nucleotide targeter (TALE-NT) 2.0: tools for TAL effector design and target prediction effector," *Nucleic Acids Research*, 40:W117-122 (2012).
Dugas et al., "MicroRNA regulation of gene expression in plants," *Current Opinion in Plant Biology*, 7:512-520 (2004).
Escamez et al., "Programmes of cell death and autolysis in tracheary elements: when a suicidal cell arranges its own corpse removal," *Journal of Experimental Botany*, 65:1313-1321 (2014).
Estruch et al., "Transgenic plants: an emerging approach to pest control," *Nature Biotechnology*, 15:137 (1997).
Fedoroff et al., "Cloning of the bronze locus in maize by a simple and generalizable procedure using the transposable controlling element Activator (Ac)," *Proceeding of the National Academy of Sciences USA*, 81:3825-3829 (1984).
Finer et al., "Transformation of soybean via particle bombardment of embryogenic suspension culture tissue," Vitro Cellular Developmental Biology, 27P:175-182 (1991).
Fisher et al., "Topping, Managing Suckers, and Using Ethepon," *Flue-Cured Tobacco Information, North Carolina State University*, 96-117 (2016).
Franco-Zorilla et al., "Target mimicry provides a new mechanism for regulation of microRNA activity," *Nature Genetics*, 39:1033-1037 (2007).
Gálweiler et al., "Regulation of polar auxin transport by AtPIN1 in *Arabidopsis* vascular tissue," *Science*, 282:2226-2230 (1998).
Gatz et al., "Regulation of a modified CaMV 35S promoter by the Tn10-encoded Tet repressor in transgenic tobacco," *Molecular and General Genetics*, 227:229-237 (1991).
Goldman et al., "Female Sterile Tobacco Plants Are Produced by Stigma," *EMBO Journal*, 13:2976-2984 (1994).
Gonzalez-Grandio et al., "BRANCHED1 Promotes Axillary Bud Dormancy in Response to Shade in *Arabidopsis,*" *Plant Cell*, 25:834-850 (2013).
Greb et al., "Molecular analysis of the Lateral Suppressor gene in *Arabidopsis* reveals a conserved control mechanism for axillary meristem formation," *Genes & Development*, 17:1175-1187 (2003).
Griffiths-Jones et al., "Rfam: an RNA family database," *Nucleic Acids Research*, 31:439-441 (2003).
Guevara-Garcia et al., "Tissue-specific and wound-inducible pattern of expression of the mannopine synthase promoter is determined by the interaction between positive and negative cis-regulatory elements," *Plant Journal*, 4:495-505 (1993).

(56) References Cited

OTHER PUBLICATIONS

Hansen et al., "Wound-inducible and organ-specific expression of ORF13 from Agrobacterium rhiZogenes 8196 T-DNA in transgenic tobacco plants," *Molecular and General Genetics*, 254:337-343 (1997).
Hartley, "Barnase and barstar: two small proteins to fold and fit together," *Trends in Biochemical Sciences*, 14:450-454 (1989).
Hildering et al., "The use of induced mutations in plant breeding," supplement to *Radiation Botany*, 5:317-320 (1965).
Hoekema et al., "A binary plant vector strategy based on separation of vir- and T-region of the *Agrobacterium tumefaciens* Ti-plasmid," *Nature*, 303:179-180 (1983).
Horsch et al., "A simple and general method for transferring genes into plants," *Science*, 227:1229-1231 (1985).
Jones-Rhoades et al., "Computational identification of plant microRNAs and their targets, including a stress-induced miRNA," *Molecular Cell*, 14:787-799 (2004).
Kaeppler et al., "Silicon carbide fiber-mediated DNA delivery into plant cells," *Plant Cell Reports*, 9:415-418 (1990).
Kaeppler et al., "Silicon carbide fiber-mediated stable transformation of plant cells," Theoretical and Applied Genetics, 84:560-566 (1992).
Katoh et al., "Specific residues at every third position of siRNA shape its efficient RNAi activity," *Nucleic Acids Research*, 35:e27 (2007).
Kawamata et al., "Temporal and spatial pattern of expression of the pea phenylalanine ammonia-lyase gene1 promoter in transgenic tobacco," *Plant and Cell Physiology*, 38:792-803 (1997).
Keller et al., "*Arabidopsis* Regulator of Axillary MERISTEMS1 Controls a Leaf Axil Stem Cell Niche and Modulates Vegetative Development," *Plant Cell*, 18:598-611 (2006).
Khvorova et al., "Functional siRNAs and miRNAs exhibit strand bias," *Cell*, 115:209-216 (2003).
Kim, "MicroRNA biogenesis: coordinated cropping and dicing," *Nature Reviews Molecular Cell Biology*, 6:376-385 (2005).
Lam "Analysis of Tissue-Specific Elements in the CaMV 35S Promoter," *Results and Problems in Cell Differentiation*, 20:181-196 (1994).
Last et al., "pEMU: an improved promoter for gene expression in cereal cells," *Theoretical and Applied Genetics*, 81:581-588 (1991).
Long et al., "A member of the knotted class of homeodomain proteins encoded by the STM gene of *Arabidopsis*," *Nature*, 379:66-69 (1996).
Matsuoka et al., "Tissue-specific light-regulated expression directed by the promoter of a C4 gene, maize pyruvate, orthophosphate dikinase, in a C3 plant, rice," *Proceedings of the National Academy of Sciences USA*, 90:9586-9590 (1993).
Mayo et al., "Genetic transformation of tobacco NT1 cells with *Agrobacterium tumefaciens*," *Nature Protocols*, 1:1105-11 (2006).
McCabe et al., "Stable transformation of soybean (Glycine max) by particle acceleration," *Biotechnology*, 6:923-926 (1988).
McCallum et al., "Targeted screening for induced mutations," *Nature Biotechnology*, 18:455-457 (2000).
McNellis et al., "Glucocorticoid-inducible expression of a bacterial avirulence gene in transgenic *Arabidopsis* induces hypersensitive cell death," *Plant Journal*, 14:247-257 (1998).
Miller, "Memorandum on the Proposed Burley Tobacco Grade Index," Legacy Tobacco Document Library, Bates Nos. 523267826-523267833 (1988).
Miller et al., "A grade index for type 22 and 23 fire-cured tobacco," *Tobacco International*, 192:55-57 (1990).
Murchison et al., "miRNAs on the move: miRNA biogenesis and the RNAi machinery," *Current Opinion in Cell Biology*, 16:223-229 (2004).
Neu et al., "*Arabidopsis* amidase 1, a member of the amidase signature family," *FEBS Journal*, 274:3440-3451 (2007).
Odell et al., "Identification of DNA sequences required for activity of the cauliflower mosaic virus 35S promoter," *Nature*, 313:810-812 (1985).
Orozco et al., "Localization of Light-Inducible and Tissue-Specific Regions of the Spinach Ribulose Bisphosphate Carboxylase/Oxygenase (Rubisco) Activase Promoter in Transgenic Tobacco Plants," *Plant Molecular Biology*, 23:1129-1138 (1993).
Ortiz-Morea et al., "Global analysis of the sugarcane microtranscriptome reveals a unique composition of small RNAs associated with axillary bud outgrowth," *Journal of Experimental Botany*, 64:2307-2320 (2013).
Parizotto et al., "In vivo investigation of the transcription, processing, endonucleolytic activity, and functional relevance of the spatial distribution of a plant miRNA," *Genes & Development*, 18:2237-2242 (2004).
Paszkiwski et al., "Direct Gene Transfer to Plants," *EMBO Journal*, 3:2717- 2722 (1984).
Porta et al., "Use of viral replicons for the expression of genes in plants," *Molecular Biotechnology*, 5:209-221 (1996).
Rajani et al., "The *Arabidopsis* myc/bHLH gene Alcatraz enables cell separation in fruit dehiscence," *Current Biology*, 11:1941-1922 (2001).
Reynolds et al., "Rational siRNA design for RNA interference," *Nature Biotechnology*, 22:326-330 (2004).
Rhoades et al., "Prediction of plant microRNA targets," *Cell*, 110:513-520 (2002).
Riggs et al., "Stable transformation of tobacco by electroporation: Evidence for plasmid concatenation," *Proceedings of the National Academy of Sciences USA*, 83:5602-5606 (1986).
Rinehart et al., "Tissue-specific and developmental regulation of cotton gene FbL2A," *Plant Physiology*, 112:1331-1341 (1996).
Russell et al., "Tissue-Specific Expression in Transgenic Maize of Four Endosperm Promoters From Maize and Rice," *Transgenic Research*, 6:157-168 (1997).
Schena et al., "A steroid-inducible gene expression system for plant cells," *Proceedings of the National Academy of Sciences USA*, 88:10421-10425 (1991).
Shillito et al., "Direct gene transfer to protoplasts of dicotyledonous and monocotyledonous plants by a number of methods, including electroporation," *Methods in Enzymology*, 153:313-336 (1987).
Singh et al., "Cytological characterization of transgenic soybean," *Theoretical and Applied Genetics*, 96:319-324 (1998).
Stepanova et al., "TAA1-Mediated Auxin Biosynthesis Is Essential for Hormone Crosstalk and Plant Development," *Cell*, 133:177-191 (2008).
Stirnberg et al., "MAX1 and MAX2 control shoot lateral branching in *Arabidopsis*," *Development*, 129:1131-1141 (2002).
Sunkar et al., "Novel and stress-regulated microRNAs and other small RNAs from *Arabidopsis*," *Plant Cell*, 16:2001-2019 (2004).
Tanaka, "Studies on Biological Effects of Ion Beams on Lethality, Molecular Nature of Mutation, Mutation Rate, and Spectrum of Mutation Phenotype for Mutation Breeding in Higher Plants," *Journal of Radiation Research*, 51:223-233 (2010).
Tanaka-Ueguchi et al., "Over-expression of a tobacco homeobox gene NTH15, decreases the expression of a gibberellin biosynthetic gene encoding GA 20- xidase," *Plant Journal*, 15:391-400 (1998).
Tomes et al., "Direct DNA Transfer into Intact Plant Cells via Microprojectile Bombardment," *Plant Cell, Tissue, and Organ Culture: Fundamental Methods* (1995).
Trobacher et al., "Induction of a ricinosomal-protease and programmed cell death in tomato endosperm by gibberellic acid," *Planta*, 237:664-679 (2013).
Van Camp et al., "Tissue-Specific Activity of Two Manganese Superoxide Dismutase Promoters in Transgenic Tobacco," *Plant Physiology*, 112:525-535 (1996).
Velten et al., "Isolation of a dual plant promotor fragment from the Ti Plasmid of Agrobacterium tumefaciens," *EMBO Journal*, 3:2723-2730 (1984).
Verkerk, "Chimerism of the tomato plant after seed irradiation with fast neutrons," *Netherlands Journal of Agricultural Science*, 19:197-203 (1971).
Wang et al., "MicroRNA171c-targeted SCL6-II, SCL6-III, and SCL6-IV genes regulate shoot branching in *Arabidopsis*," *Molecular Plant*, 3:794-806 (2010).

(56) References Cited

OTHER PUBLICATIONS

Watanabe et al., "*Arabidopsis* metacaspase 2d is a positive mediator of cell death induced during biotic and abiotic stresses," *Plant Journal*, 66:969-982 (2011).
Weising et al., "Foreign Genes in Plants: Transfer, Structure, Expression, and Applications," *Annual Review of Genetics*, 22:421-477 (1988).
Wernsman et al., "Tobacco" Chapter 17, *Principles of Cultivar Development*, 669-698 (1987).
Yadav et al., "WUSCHEL protein movement mediates stem cell homeostasis in the *Arabidopsis* shoot apex," *Genes & Development*, 25:2025-2030 (2011).
Yamada et al., "The TRANSPORT INHIBITOR RESPONSE2 Gene Is Required for Auxin Synthesis and Diverse Aspects of Plant Development," *Plant Physiology*, 151:168-179 (2009).
Yamamoto et al., "The Promoter of a Pine Photosynthetic Gene Allows Expression of a jS-Glucuronidase Reporter Gene in Transgenic Rice Plants in a Light-Independent but Tissue-Specific Manner," *Plant & Cell Physiology*, 35:773-778 (1994).
Yamamoto et al., "Light-Responsive Elements of the Tobacco PSI-D Gene Are Located Both Upstream and Within the Transcribed Region," *Plant Journal*, 12:255-265 (1997).
Zeng et al., "Both natural and designed micro RNAs can inhibit the expression of cognate mRNAs when expressed in human cells," *Molecular Cell*, 9:1327-1333 (2002).
Zhang et al., "Transcription activator-like effector nucleases enable efficient plant genome engineering," *Plant Physiology*, 161:20-27 (2013).
Boutros et al., "Genome-Wide RNAi Analysis of Growth and Viability in *Drosophila* Cells," *Science*, 303:832-835 (2004).
Byrne, "Shoot Meristem Function and Leaf Polarity: The Role of Class III HD-ZIP Genes," *PLoS Genetics*, 2(6):e89 (2006).
Dietzl et al., "A genome-wide transgenic RNAi library for conditional gene activation in *Drosophila,*" *Nature*, 448:151-156 (2007).
Goehring et al., "Screening and large-scale expression of membrane proteins in mammalian cells for structural studies," *Nat. Protoc.*, 9:2574-2585 (2014).
Greene et al, "Spectrum of Chemically Induced Mutations From a Large-Scale Reverse-Genetic Screen in *Arabidopsis,*" *Genetics*, 164:731-740 (2003).
Guo et al., "Protein tolerance to random amino acid change," *Proc. Natl. Acad. Sci. USA*, 101:9205-9210 (2004).
Hormoz, "Amino acid composition of proteins reduces deleterious impact of mutations," *Scientific Reports*, 3:2919 (2013).
*IUBMB Enzyme Nomenclature* (2005), accessed online on Sep. 12, 2019.
Lee et al., "A systematic RNAi screen identifies a critical role for mitochondria in *C. elegans* longevity," *Nature Genetics*, 33:40-48 (2003).
Mallory et al., "MicroRNA control of PHABULOSA in leaf development: importance of pairing to the microRNA 5' region," *EMBO J*, 23:3356-3364 (2004).
Wilke et al., "Predicting the Tolerance of Proteins to Random Amino Acid Substitution," *Biophysical Journal*, 89:3714-3720 (2005).

\* cited by examiner

Axillary Shoots

Control

SEQ ID NO: 96

Seedling

Seedling SAM

SAM          Axillary Buds 0 hours    0 hours    3 days    5 days    7 days

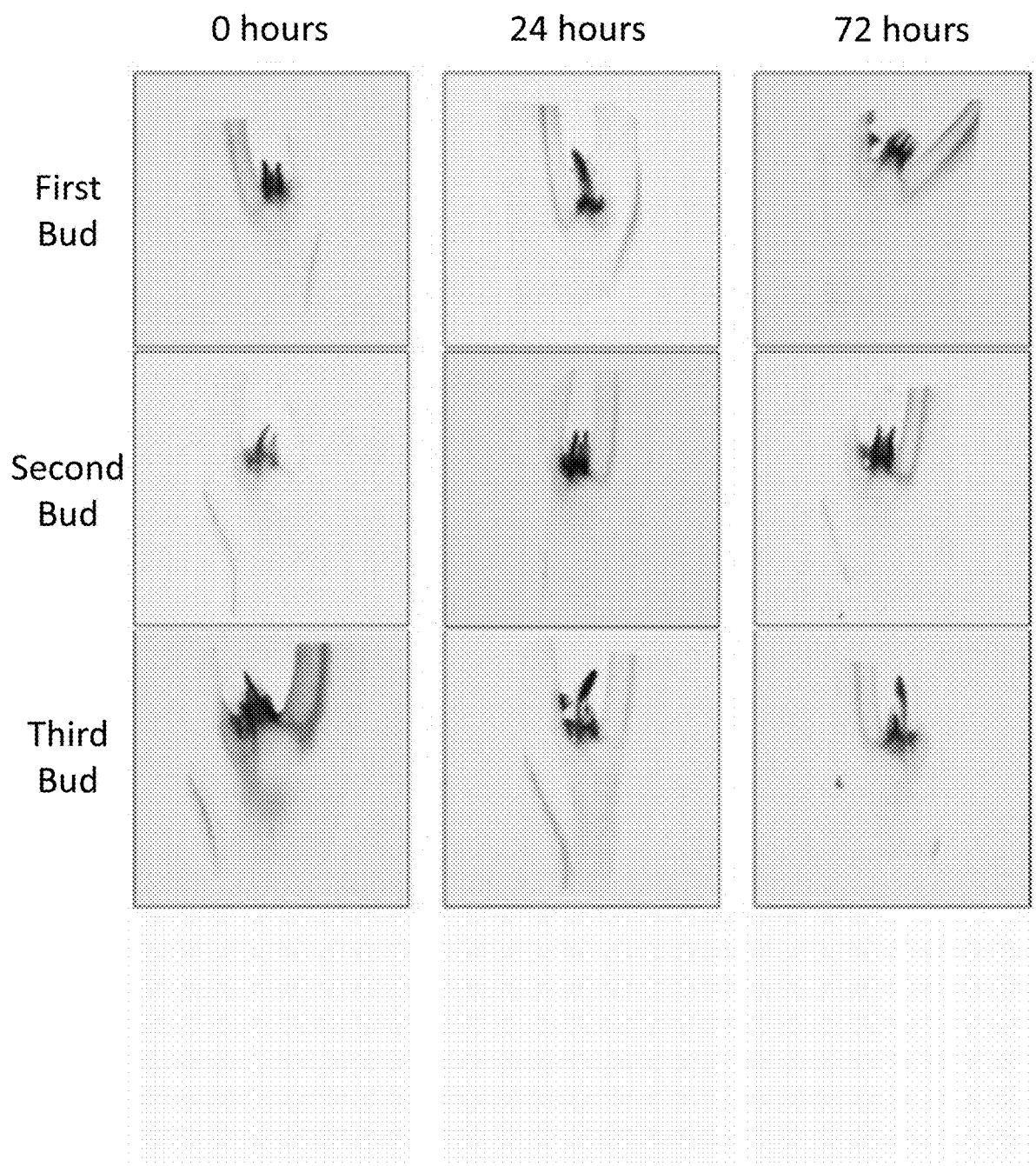

SAM and Axillary Buds    Axillary Bud

SAM and Axillary Buds    Axillary Bud

Control

SEQ ID NO: 117 (promoter) driving SEQ ID NO: 59

Positive Control (SEQ ID NO: 79)

Negative Control (Empty vector)

SEQ ID NO: 203

SEQ ID NO: 208

SEQ ID NO: 209

SEQ ID NO: 210

SEQ ID NO: 216

SEQ ID NO: 228

SEQ ID NO: 230

SEQ ID NO: 232

COMPOSITIONS AND METHODS FOR PRODUCING TOBACCO PLANTS AND PRODUCTS HAVING REDUCED OR ELIMINATED SUCKERS

CROSS-REFERENCE TO RELATED APPLICATIONS

This application claims priority to U.S. Provisional Patent Application No. 62/307,035, filed Mar. 11, 2016, and U.S. Provisional Patent Application No. 62/399,181, filed Sep. 23, 2016. All the foregoing applications are incorporated by reference in their entirety herein.

FIELD

The present disclosure identifies axillary bud-specific promoters and genes involved in sucker growth. Also provided are methods and compositions related to reducing or eliminating suckers in tobacco plants, their development via breeding or transgenic approaches, and production of tobacco products from those tobacco plants.

INCORPORATION OF SEQUENCE LISTING

A sequence listing contained in the file named "P34370US02_SL.TXT" which is 729,504 bytes (measured in MS-Windows®) and created on Feb. 24, 2017 is filed electronically herewith and incorporated by reference in its entirety.

BACKGROUND

Tobacco is a plant species that exhibits exceptionally strong apical dominance. Molecular signals from the shoot apical meristem (SAM) mediate a hormonal signal that effectively inhibits axillary bud growth. Upon removal of the SAM (also known as "topping"), physiological and molecular changes occur, enabling the growth of new shoots (or "suckers") from axillary meristems (buds). Sucker growth results in loss of yield and leaf quality. Suckers have been controlled by manual removal and through the application of chemicals. Maleic hydrazide and flumetralin are routinely used on topped plants to inhibit axillary bud growth ("suckering"). However, labor and chemical agents to control suckers are very expensive. Control of suckering in tobacco through conventional breeding, mutation breeding, and transgenic approaches have been a major objective for several decades but, to date, successful inhibition or elimination of suckering has not been achieved through these approaches. Therefore, development of tobacco traits with limited or no suckering would result in a reduction of the use of chemical agents and would reduce costs and labor associated with tobacco production.

SUMMARY

In one aspect, the present disclosure provides a modified tobacco plant comprising no or reduced suckering compared to a control tobacco plant of the same variety when grown under comparable conditions.

In one aspect, the present disclosure provides a modified tobacco plant, where the modified tobacco plant exhibits: inhibited or eliminated axillary meristem growth; inhibited or eliminated axillary meristem maintenance; or a combination thereof compared to a control tobacco plant of the same variety when grown under comparable conditions.

In one aspect, the present disclosure provides a plant or seed comprising a recombinant polynucleotide, where the recombinant polynucleotide comprises a promoter that is functional in an L1 layer, an L2 layer, an L3 region, a rib zone, a central zone, a peripheral zone, or any combination thereof, which is operably linked to a structural nucleic acid molecule comprising a nucleic acid sequence, where the nucleic acid sequence encodes a polypeptide having at least 70% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

In one aspect, the present disclosure provides a recombinant DNA construct comprising a promoter that is functional in an L1 layer, an L2 layer, an L3 region, a rib zone, a central zone, a peripheral zone, or a combination thereof; and a heterologous and operably linked nucleic acid sequence, where the nucleic acid sequence encodes a non-coding RNA or a polypeptide.

In one aspect, the present disclosure provides a method of reducing or eliminating topping-induced suckering in a tobacco plant, where the method comprises transforming a tobacco plant with a recombinant DNA construct comprising a promoter functional in an L1 layer, an L2 layer, an L3 region, a rib zone, a central zone, a peripheral zone, or a combination thereof.

In one aspect, the present disclosure provides a method comprising transforming a tobacco plant with a recombinant DNA construct comprising a heterologous promoter that is functional in an L1 layer, an L2 layer, an L3 region, a rib zone, a central zone, a peripheral zone, or a combination thereof, and is operably linked to a polynucleotide that is transcribed into an RNA molecule that suppresses the level of an endogenous gene, and where the endogenous gene promotes or is required for axillary meristem growth, axillary meristem maintenance, or both.

In one aspect, the present disclosure provides a method for producing a tobacco plant comprising crossing at least one tobacco plant of a first tobacco variety with at least one tobacco plant of a second tobacco variety, where the at least one tobacco plant of the first tobacco variety exhibits no or reduced topping-induced suckering compared to a control tobacco plant of the same variety grown under comparable conditions; and selecting for progeny tobacco plants that exhibit no or reduced topping-induced suckering compared to a control tobacco plant of the same cross grown under comparable conditions.

In one aspect, the present disclosure provides a tobacco plant, or part thereof, comprising a heterologous promoter operably linked to a polynucleotide encoding a polypeptide having at least 70% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

In one aspect, the present disclosure provides a recombinant DNA construct comprising a heterologous promoter operably linked to a polynucleotide encoding a polypeptide having at least 70% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

In one aspect, the present disclosure provides a method of growing a modified tobacco plant comprising planting a modified tobacco seed comprising a heterologous promoter that is operably linked to a polynucleotide encoding a polypeptide having at least 70% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255; and growing the modified tobacco plant from the seed.

In one aspect, the present disclosure provides a method for controlling topping-induced suckering in a plant comprising transforming the plant with a recombinant DNA construct, where the recombinant DNA construct comprises a promoter that is operably linked to a polynucleotide encoding a polypeptide having at least 70% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

In one aspect, the present disclosure provides a tobacco plant, or part thereof, comprising a heterologous promoter operably linked to a polynucleotide that encodes a non-coding RNA molecule, where the non-coding RNA molecule is capable of binding to an RNA encoding a polypeptide having at least 70% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 70, 72, 74, 76, 78, 161-185, 187, 189, 191, 197, 199, 224, 229, 231, 233, 235, 237, 239, 241, 243, 245, 247, 249, 251, 253, and 255, and where the non-coding RNA molecule suppresses the expression of the polypeptide.

In one aspect, the present disclosure provides a recombinant DNA construct comprising a heterologous axillary meristem-specific promoter operably linked to a polynucleotide that encodes a non-coding RNA molecule, where the non-coding RNA molecule is capable of binding to an RNA encoding a polypeptide having at least 70% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 70, 72, 74, 76, 78, 161-185, 187, 189, 191, 197, 199, 224, 229, 231, 233, 235, 237, 239, 241, 243, 245, 247, 249, 251, 253, and 255, and where the non-coding RNA molecule suppresses the expression of the polypeptide.

In one aspect, the present disclosure provides a method of growing a modified tobacco plant comprising planting a modified tobacco seed comprising a recombinant DNA construct comprising a heterologous promoter that is functional in an L1 layer, an L2 layer, an L3 region, a rib zone, a central zone, a peripheral zone, or a combination thereof, and is operably linked to a polynucleotide that encodes a non-coding RNA molecule, where the non-coding RNA molecule is capable of binding to an RNA encoding a polypeptide having at least 70% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 70, 72, 74, 76, 78, 161-185, 187, 189, 191, 197, 199, 224, 229, 231, 233, 235, 237, 239, 241, 243, 245, 247, 249, 251, 253, and 255, and where the non-coding RNA molecule suppresses the expression of the polypeptide; and growing the modified tobacco plant from the seed.

In one aspect, the present disclosure provides a method for controlling topping-induced suckering in a plant comprising transforming the plant with a recombinant DNA construct, where the recombinant DNA construct comprises a heterologous promoter that is functional in an L1 layer, an L2 layer, an L3 region, a rib zone, a central zone, a peripheral zone, or a combination thereof, and where the promoter is operably linked to a polynucleotide that encodes a non-coding RNA molecule, where the non-coding RNA molecule is capable of binding to an RNA encoding a polypeptide having at least 70% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 70, 72, 74, 76, 78, 161-185, 187, 189, 191, 197, 199, 224, 229, 231, 233, 235, 237, 239, 241, 243, 245, 247, 249, 251, 253, and 255, and where the non-coding RNA molecule suppresses the expression of the polypeptide.

In one aspect, the present disclosure provides a bacterial cell comprising a recombinant DNA construct provided herein.

In one aspect, the present disclosure provides a plant genome comprising a recombinant DNA construct provided herein.

In one aspect, the present disclosure provides a method for manufacturing a modified seed comprising introducing a recombinant DNA construct provided herein into a plant cell; screening a population of plant cells for the recombinant DNA construct; selecting one or more plant cells from the population, generating one or more modified plants from the one or more plant cells; and collecting one or more modified seeds from the one or more modified plants.

In one aspect, the present disclosure provides a method of producing a modified tobacco plant to reduce or eliminate suckering, where the method comprises introducing one or more mutations in one or more tobacco genome loci.

In one aspect, the present disclosure provides a method of producing a modified tobacco plant to reduce or eliminate suckering, where the method comprises introducing one or more mutations in one or more tobacco genome loci, and where tobacco products are made from the modified tobacco plants.

In one aspect, the present disclosure provides a plant or seed comprising a recombinant polynucleotide, where the recombinant polynucleotide comprises a promoter that is functional in an L1 layer, an L2 layer, an L3 region, a rib zone, a central zone, a peripheral zone, or any combination thereof, which is operably linked to a structural nucleic acid molecule comprising a nucleic acid sequence, where the nucleic acid sequence encodes an auxin biosynthesis protein or an auxin transport protein.

In one aspect, the present disclosure provides a recombinant DNA construct comprising a promoter that is functional in an L1 layer, an L2 layer, an L3 region, a rib zone, a central zone, a peripheral zone, or any combination thereof; and a heterologous and operably linked nucleic acid sequence, where the nucleic acid sequence encodes an auxin biosynthesis protein or an auxin transport protein.

In one aspect, the present disclosure provides a recombinant DNA construct comprising a heterologous axillary meristem-specific promoter operably linked to a polynucleotide that encodes an auxin biosynthesis protein or an auxin transport protein.

In one aspect, the present disclosure provides a tobacco plant, or part thereof, comprising a heterologous promoter having at least 90% sequence identity to a polynucleotide selected from the group consisting of SEQ ID NOs: 113-118, 148-160, 204, and fragments thereof operably linked to a polynucleotide encoding an auxin biosynthesis protein or an auxin transport protein.

In one aspect, the present disclosure provides a method for controlling topping-induced suckers in a plant comprising transforming said plant with a recombinant DNA construct, where the recombinant DNA construct comprises a promoter that is operably linked to a polynucleotide encoding an auxin biosynthesis protein or an auxin transport protein.

BRIEF DESCRIPTION OF THE SEQUENCES

SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83-160, 186, 188, 190, 192, 194, 196, 198, 200, 202, 204, 205, 207, 209, 211, 213, 215, 217, 219, 221, 223, 225-228, 230, 232, 234, 236, 238, 240, 242, 244, 246, 248, 250, 252, and 254 are nucleic acid sequences. SEQ ID NOs: 83-101 are RNAi constructs. SEQ ID NOs: 113-118, 148-160, and 204 are promoter or regulatory nucleic acid sequences. SEQ ID NOs: 119-122 are sequences used in TALEN mutagenesis.

SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255 are polypeptide sequences. Additional descriptions of the SEQ ID NOs provided herein can be found in Table 1.

TABLE 1

Description of sequences

| SEQ ID NO | Sequence Type | Sequence Description | NCBI Accession Number of the Top Hit of A BLAST Search |
|---|---|---|---|
| 1 | Nucleic Acid | Transcription factor CYCLOIDEA-like | XM_009609861.1 |
| 2 | Peptide | Transcription factor CYCLOIDEA-like | |
| 3 | Nucleic Acid | Flower-specific gamma-thionin | P32026.1 |
| 4 | Peptide | Flower-specific gamma-thionin | |
| 5 | Nucleic Acid | Polyphenoloxidase | XP_006347083.1 |
| 6 | Peptide | Polyphenoloxidase | |
| 7 | Nucleic Acid | UDP-glucose:glucosyltransferase | BAG80546.1 |
| 8 | Peptide | UDP-glucose:glucosyltransferase | |
| 9 | Nucleic Acid | Tumor-related protein | BAA05479.1 |
| 10 | Peptide | Tumor-related protein | |
| 11 | Nucleic Acid | Hypothetical protein | CAN66732.1 |
| 12 | Peptide | Hypothetical protein | |
| 13 | Nucleic Acid | TCP1 protein-like gene | FJ194953.1 |
| 14 | Peptide | TCP1 protein-like gene | |
| 15 | Nucleic Acid | Chlorophyllase-2 | EYU43828.1 |
| 16 | Peptide | Chlorophyllase-2 | |
| 17 | Nucleic Acid | AP2/ERF domain-containing transcription factor | XP_006363442.1 |
| 18 | Peptide | AP2/ERF domain-containing transcription factor | |
| 19 | Nucleic Acid | Putative miraculin | XP_006360306.1 |
| 20 | Peptide | Putative miraculin | |
| 21 | Nucleic Acid | Oleosin | XP_004236249.1 |
| 22 | Peptide | Oleosin | |
| 23 | Nucleic Acid | ACC synthase | XP_006356827.1 |
| 24 | Peptide | ACC synthase | |
| 25 | Nucleic Acid | LOB domain-containing protein 18-like | XP_007052037.1 |
| 26 | Peptide | LOB domain-containing protein 18-like | |
| 27 | Nucleic Acid | Vicilin-like antimicrobial peptides cupin super family | XP_006363154.1 |
| 28 | Peptide | Vicilin-like antimicrobial peptides cupin super family | |
| 29 | Nucleic Acid | Abscisic acid insensitive | XP_006341248.1 |
| 30 | Peptide | Abscisic acid insensitive | |
| 31 | Nucleic Acid | Seipin-like | XP_004237589.1 |
| 32 | Peptide | Seipin-like | |

TABLE 1-continued

Description of sequences

| SEQ ID NO | Sequence Type | Sequence Description | NCBI Accession Number of the Top Hit of A BLAST Search |
|---|---|---|---|
| 33 | Nucleic Acid | Transcription factor CYCLOIDEA-like | XM_009618194.1 |
| 34 | Peptide | Transcription factor CYCLOIDEA-like | |
| 35 | Nucleic Acid | Transcription factor DICHOTOMA-like | XM_009593876.1 |
| 36 | Peptide | Transcription factor DICHOTOMA-like | |
| 37 | Nucleic Acid | Transcription factor CYCLOIDEA-like | XM_009764845.1 |
| 38 | Peptide | Transcription factor CYCLOIDEA-like | |
| 39 | Nucleic Acid | RING-H2 finger protein ATL11-like | XP_004251547.1 |
| 40 | Peptide | RING-H2 finger protein ATL11-like | |
| 41 | Nucleic Acid | Homeobox-leucine zipper protein ATHB-40-like | XP_004232382.1 |
| 42 | Peptide | Homeobox-leucine zipper protein ATHB-40-like | |
| 43 | Nucleic Acid | Uncharacterized protein- LOC102586855 isoform X1 | XP_006357617.1 |
| 44 | Peptide | Uncharacterized protein- LOC102586855 isoform X1 | |
| 45 | Nucleic Acid | Unknown | CAN63006.1 |
| 46 | Peptide | Unknown | |
| 47 | Nucleic Acid | MADS affecting flowering 5-like isoform X1/X2 | XP_006366525.1 |
| 48 | Peptide | MADS affecting flowering 5-like isoform X1/X2 | |
| 49 | Nucleic Acid | Nuclear transcription factor Y subunit | XP_006351227.1 |
| 50 | Peptide | Nuclear transcription factor Y subunit | |
| 51 | Nucleic Acid | Nuclear transcription factor Y subunit A-7-like | XP_006351229.1 |
| 52 | Peptide | Nuclear transcription factor Y subunit A-7-like | |
| 53 | Nucleic Acid | Transcription factor CYCLOIDEA-like | XM_009767637.1 |
| 54 | Peptide | Transcription factor CYCLOIDEA-like | |
| 55 | Nucleic Acid | *Arabidopsis* cytokinin oxidase | NM_129714.3 |
| 56 | Peptide | *Arabidopsis* cytokinin oxidase | |
| 57 | Nucleic Acid | *Nicotiana tabacum* cytokinin oxidase | XM_009611148.1 |
| 58 | Peptide | *Nicotiana tabacum* cytokinin oxidase | |
| 59 | Nucleic Acid | *Nicotiana tabacum* cytokinin oxidase | XM_009632505.1 |
| 60 | Peptide | *Nicotiana tabacum* cytokinin oxidase | |
| 61 | Nucleic Acid | *Nicotiana tabacum* Isopentenyl transferase gene (IPT-g120126) | XM_009784416.1 |
| 62 | Peptide | *Nicotiana tabacum* Isopentenyl transferase gene (IPT-g120126) | |
| 63 | Nucleic Acid | *Nicotiana tabacum* WUSCHEL (WUS-g151887) | XM_009589135.1 |
| 64 | Peptide | *Nicotiana tabacum* WUSCHEL (WUS-g151887) | |
| 65 | Nucleic Acid | *Nicotiana tabacum* WUSCHEL (WUS-g135280) | XM_009793912.1 |
| 66 | Peptide | *Nicotiana tabacum* WUSCHEL (WUS-g135280) | |
| 67 | Nucleic Acid | *Arabidopsis thaliana* CLAVATA3 (CLV3) | NM_001124926.1 |
| 68 | Peptide | *Arabidopsis thaliana* CLAVATA3 (CLV3) | |
| 69 | Nucleic Acid | *Nicotiana tabacum* CLAVATA3 (Scaffold00010610) | XM_009628563.1 |
| 70 | Peptide | *Nicotiana tabacum* CLAVATA3 (Scaffold00010610) | |
| 71 | Nucleic Acid | *Nicotiana tabacum* LATERAL SUPPRESSOR (g56830) | XM_009619761.1 |
| 72 | Peptide | *Nicotiana tabacum* LATERAL SUPPRESSOR (g56830) | |
| 73 | Nucleic Acid | *Nicotiana tabacum* LATERAL SUPPRESSOR (scafflod0004261) | XM_009766770.1 |
| 74 | Peptide | *Nicotiana tabacum* LATERAL SUPPRESSOR (scafflod0004261) | |

TABLE 1-continued

Description of sequences

| SEQ ID NO | Sequence Type | Sequence Description | NCBI Accession Number of the Top Hit of A BLAST Search |
|---|---|---|---|
| 75 | Nucleic Acid | *Nicotiana tabacum* REGULATOR OF AXILLARY MERISTEMS (RAX-scaffold0000950) | XM_009802273.1 |
| 76 | Peptide | *Nicotiana tabacum* REGULATOR OF AXILLARY MERISTEMS (RAX-scaffold0000950) | |
| 77 | Nucleic Acid | *Nicotiana tabacum* REGULATOR OF AXILLARY MERISTEMS (RAX-scaffold00001904) | XM_009602411.1 |
| 78 | Peptide | *Nicotiana tabacum* REGULATOR OF AXILLARY MERISTEMS (RAX-scaffold00001904) | |
| 79 | Nucleic Acid | *Bacillus amyloliquefaciens* extracellular ribonuclease (Barnase) | CP009748.1 |
| 80 | Peptide | *Bacillus amyloliquefaciens* extracellular ribonuclease (Barnase) | |
| 81 | Nucleic Acid | *Arabidopsis thaliana* BRANCHED1 | NM_001125184.1 |
| 82 | Peptide | *Arabidopsis thaliana* BRANCHED1 | |
| 83 | Nucleic Acid | RNAi_1 (targeting SEQ ID NO: 1) | |
| 84 | Nucleic Acid | RNAi_2 (targeting SEQ ID NO: 3) | |
| 85 | Nucleic Acid | RNAi_5 (targeting SEQ ID NO: 9) | |
| 86 | Nucleic Acid | RNAi_7 (targeting SEQ ID NO: 13) | |
| 87 | Nucleic Acid | RNAi_8 (targeting SEQ ID NO: 15) | |
| 88 | Nucleic Acid | RNAi_9 (targeting SEQ ID NO: 17) | |
| 89 | Nucleic Acid | RNAi_10 (targeting SEQ ID NO: 19) | |
| 90 | Nucleic Acid | RNAi_12 (targeting SEQ ID NO: 21) | |
| 91 | Nucleic Acid | RNAi_14 (targeting SEQ ID NO: 25) | |
| 92 | Nucleic Acid | RNAi_15 (targeting SEQ ID NO: 27) | |
| 93 | Nucleic Acid | RNAi_16 (targeting SEQ ID NO: 29) | |
| 94 | Nucleic Acid | RNAi_17 (targeting SEQ ID NO: 31) | |
| 95 | Nucleic Acid | RNAi_18 (targeting SEQ ID NO: 35) | |
| 96 | Nucleic Acid | RNAi_26 (targeting SEQ ID NO: 49) | |
| 97 | Nucleic Acid | RNAi_61 (targeting SEQ ID NO: 61) | |
| 98 | Nucleic Acid | RNAi_63 and 65 (targeting SEQ ID NO: 63 and 65) | |
| 99 | Nucleic Acid | RNAi_71 and 73 (targeting SEQ ID NO: 71 and 73) | |
| 100 | Nucleic Acid | RNAi_75 and 77 (targeting SEQ ID NO: 75 and 77) | |
| 101 | Nucleic Acid | RNAi_CET-26-6 (targeting SEQ ID NO: 11, 49, 108, 109 and 110) | |
| 102 | Nucleic Acid | RNAi_45-2-7-TDNA-145337-RI (targeting SEQ ID NO: 39) | |
| 103 | Nucleic Acid | RNAi_45-2-7-TDNA-348CDS-RI (targeting SEQ ID NO: 41) | |
| 104 | Nucleic Acid | RNAi_45-2-7-TDNA-131180CDS-RI (targeting SEQ ID NO: 43) | |
| 105 | Nucleic Acid | RNAi_45-2-7-TDNA-22266-RI (targeting SEQ ID NO: 45) | |
| 106 | Nucleic Acid | RNAi_45-2-7-TDNA-53803/75660-RI (targeting SEQ ID NO: 49) | |
| 107 | Nucleic Acid | RNAi_45-2-7-TDNA-21860-RI (targeting SEQ ID NO: 47) | |
| 108 | Nucleic Acid | CEN-like protein 2 (CET2) g114109 | AF145260.1 |
| 109 | Nucleic Acid | CEN-like protein 2 (CET2) g2420 | XM_009596199.1 |
| 110 | Nucleic Acid | CEN-like protein 2 (CET2) Scaffold0003597 CDS | XM_009787775.1 |

TABLE 1-continued

Description of sequences

| SEQ ID NO | Sequence Type | Sequence Description | NCBI Accession Number of the Top Hit of A BLAST Search |
|---|---|---|---|
| 111 | Nucleic Acid | Transformation cassette | |
| 112 | Nucleic Acid | *Agrobacterium* transformation vector p45-2-7 | |
| 113 | Nucleic Acid | A promoter sequence of a gene encoding SEQ ID NO: 2 (Gene 1) | |
| 114 | Nucleic Acid | A promoter sequence of a gene encoding SEQ ID NO: 8 (Gene 4) | |
| 115 | Nucleic Acid | A promoter sequence of a gene encoding SEQ ID NO: 14 (Gene 7) | |
| 116 | Nucleic Acid | promoter of SEQ ID NO: 275 (Gene 11) | |
| 117 | Nucleic Acid | A promoter sequence of a gene encoding SEQ ID NO: 28 (Gene 15) | |
| 118 | Nucleic Acid | A promoter sequence of a gene encoding SEQ ID NO: 4 (Gene 2) | |
| 119 | Nucleic Acid | Sequence for TALEN donor, which targets a gene encoding SEQ ID NO: 1 | |
| 120 | Nucleic Acid | Sequence for TALEN binding sites, which targets a gene encoding SEQ ID NO: 1 | |
| 121 | Nucleic Acid | Sequence for TALEN, include promoter NO: 118, NO: 113 which targets a gene encoding SEQ ID NO: 13 | |
| 122 | Nucleic Acid | Sequence for TALEN biding sites, which targets a gene encoding SEQ ID NO: 13 | |
| 123 | Nucleic Acid | *Nicotiana tabacum* T2 Rnase | XP_009794914.1 |
| 124 | Nucleic Acid | *Nicotiana tabacum* T2 Rnase | XP_009766067.1 |
| 125 | Nucleic Acid | *Nicotiana tabacum* P1 Rnase | XP_009597823.1 |
| 126 | Nucleic Acid | *Nicotiana tabacum* Rnase | XP_009775662.1 |
| 127 | Nucleic Acid | *Nicotiana tabacum* T2 Rnase | XM_009794797.1 |
| 128 | Nucleic Acid | *Nicotiana tabacum* T2 Rnase | XM_009627900.1 |
| 129 | Nucleic Acid | *Nicotiana tabacum* T2 Rnase | JQ041907.1 |
| 130 | Nucleic Acid | *Nicotiana tabacum* T2 Rnase | XM_009795594.1 |
| 131 | Nucleic Acid | *Nicotiana tabacum* T2 Rnase | XM_009795502.1 |
| 132 | Nucleic Acid | *Nicotiana tabacum* I2 Rnase | XM_009606804.1 |
| 133 | Nucleic Acid | *Nicotiana tabacum* I2 Rnase | XM_009794798.1 |
| 134 | Nucleic Acid | *Nicotiana tabacum* I2 Rnase | AB034638.1 |
| 135 | Nucleic Acid | *Nicotiana tabacum* I2 Rnase | XM_009784762.1 |
| 136 | Nucleic Acid | *Nicotiana tabacum* I2 Rnase | XM_009798107.1 |
| 137 | Nucleic Acid | VPE14 | XM_009773063.1 |
| 138 | Nucleic Acid | VPE15 | XM_009594104.1 |
| 139 | Nucleic Acid | VPE16 | XM_009784979.1 |
| 140 | Nucleic Acid | VPE17 | XM_009765910.1 |
| 141 | Nucleic Acid | VPE4 | XM_009623321.1 |
| 142 | Nucleic Acid | VPE6 | XM_009764257.1 |
| 143 | Nucleic Acid | VPE7 | AB075949.1 |
| 144 | Nucleic Acid | *Nicotiana tabacum* Proteinase | XM_009801188.1 |
| 145 | Nucleic Acid | *Nicotiana tabacum* Proteinase | XM_009792063.1 |
| 146 | Nucleic Acid | *Nicotiana tabacum* Proteinase | XM_009779330.1 |
| 147 | Nucleic Acid | *Nicotiana tabacum* Proteinase | XM_009764284.1 |

TABLE 1-continued

Description of sequences

| SEQ ID NO | Sequence Type | Sequence Description | NCBI Accession Number of the Top Hit of A BLAST Search |
|---|---|---|---|
| 148 | Nucleic Acid | Thionin 5' upstream regulatory sequence | |
| 149 | Nucleic Acid | *Nicotiana tabacum* Lateral Suppressor1 (LAS1) 5' upstream regulatory sequence | |
| 150 | Nucleic Acid | *Nicotiana tabacum* LAS1 3' downstream regulatory sequence | |
| 151 | Nucleic Acid | *Nicotiana tabacum* LAS2 5' upstream regulatory sequence | |
| 152 | Nucleic Acid | *Nicotiana tabacum* LAS2 3' downstream regulatory sequence | |
| 153 | Nucleic Acid | *Nicotiana tabacum* Regulator of Axillary Meristems1 (RAX1) 5' upstream regulatory sequence | |
| 154 | Nucleic Acid | *Nicotiana tabacum* RAX1 3' downstream regulatory sequence | |
| 155 | Nucleic Acid | *Nicotiana tabacum* RAX2 5' upstream regulatory sequence | |
| 156 | Nucleic Acid | *Nicotiana tabacum* RAX2 3' downstream regulatory sequence | |
| 157 | Nucleic Acid | SEQ ID NO: 27 5' upstream regulatory sequence | |
| 158 | Nucleic Acid | SEQ ID NO: 27 3' downstream regulatory sequence | |
| 159 | Nucleic Acid | SEQ ID NO: 27 homolog 5' upstream regulatory sequence | |
| 160 | Nucleic Acid | SEQ ID NO: 27 homolog 3' downstream regulatory sequence | |
| 161 | Peptide | *Nicotiana tabacum* T2 Rnase encoded by SEQ ID NO: 123 | |
| 162 | Peptide | *Nicotiana tabacum* T2 Rnase encoded by SEQ ID NO: 124 | |
| 163 | Peptide | *Nicotiana tabacum* P1 Rnase encoded by SEQ ID NO: 125 | |
| 164 | Peptide | *Nicotiana tabacum* Rnase encoded by SEQ ID NO: 126 | |
| 165 | Peptide | *Nicotiana tabacum* T2 Rnase encoded by SEQ ID NO: 127 | |
| 166 | Peptide | *Nicotiana tabacum* T2 Rnase encoded by SEQ ID NO: 128 | |
| 167 | Peptide | *Nicotiana tabacum* T2 Rnase encoded by SEQ ID NO: 129 | |
| 168 | Peptide | *Nicotiana tabacum* T2 Rnase encoded by SEQ ID NO: 130 | |
| 169 | Peptide | *Nicotiana tabacum* T2 Rnase encoded by SEQ ID NO: 131 | |
| 170 | Peptide | *Nicotiana tabacum* T2 Rnase encoded by SEQ ID NO: 132 | |
| 171 | Peptide | *Nicotiana tabacum* T2 Rnase encoded by SEQ ID NO: 133 | |
| 172 | Peptide | *Nicotiana tabacum* T2 Rnase encoded by SEQ ID NO: 134 | |
| 173 | Peptide | *Nicotiana tabacum* T2 Rnase encoded by SEQ ID NO: 135 | |
| 174 | Peptide | *Nicotiana tabacum* T2 Rnase encoded by SEQ ID NO: 136 | |
| 175 | Peptide | VPE14 encoded by SEQ ID NO: 137 | |
| 176 | Peptide | VPE15 encoded by SEQ ID NO: 138 | |
| 177 | Peptide | VPE16 encoded by SEQ ID NO: 139 | |
| 178 | Peptide | VPE17 encoded by SEQ ID NO: 140 | |
| 179 | Peptide | VPE4 encoded by SEQ ID NO: 141 | |
| 180 | Peptide | VPE6 encoded by SEQ ID NO: 142 | |
| 181 | Peptide | VPE7 encoded by SEQ ID NO: 143 | |
| 182 | Peptide | *Nicotiana tabacum* Proteinase encoded by SEQ ID NO: 144 | |
| 183 | Peptide | *Nicotiana tabacum* Proteinase encoded by SEQ ID NO: 145 | |
| 184 | Peptide | *Nicotiana tabacum* Proteinase encoded by SEQ ID NO: 146 | |
| 185 | Peptide | *Nicotiana tabacum* Proteinase encoded by SEQ ID NO: 147 | |
| 186 | Nucleic Acid | C12866 (Gene 11) | XP_006467846.1 |
| 187 | Peptide | C12866 (Gene 11) | |
| 188 | Nucleic Acid | *Nicotiana tabacum* STM homolog (NTH15) | AB004785 |

TABLE 1-continued

Description of sequences

| SEQ ID NO | Sequence Type | Sequence Description | NCBI Accession Number of the Top Hit of A BLAST Search |
|---|---|---|---|
| 189 | Peptide | *Nicotiana tabacum* STM homolog (NTH15) | |
| 190 | Nucleic Acid | *Nicotiana tabacum* (Grassy Tillers1) GT1 homolog | |
| 191 | Peptide | *Nicotiana tabacum* (Grassy Tillers1) GT1 homolog | |
| 192 | Nucleic Acid | *Arabidopsis thaliana* More Axillary Branching1 (MAX1) | AK316903.1 |
| 193 | Peptide | *Arabidopsis thaliana* More Axillary Branching1 (MAX1) | |
| 194 | Nucleic Acid | *Arabidopsis thaliana* MAX2 | AAK97303.1 |
| 195 | Peptide | *Arabidopsis thaliana* MAX2 | |
| 196 | Nucleic Acid | *Nicotiana tabacum* MAX1 homolog | XM_009801023.1 |
| 197 | Peptide | *Nicotiana tabacum* MAX1 homolog | |
| 198 | Nucleic Acid | *Nicotiana tabacum* MAX2 homolog | XM_009625596.1 |
| 199 | Peptide | *Nicotiana tabacum* MAX2 homolog | |
| 200 | Nucleic Acid | *Arabidopsis thaliana* Lateral Suppressor (LAS) | BT026519.1 |
| 201 | Peptide | *Arabidopsis thaliana* Lateral Suppressor (LAS) | |
| 202 | Nucleic Acid | *Arabidopsis thaliana* Regulator of Axillary Meristems (RAX) | AY519628.1 |
| 203 | Peptide | *Arabidopsis thaliana* Regulator of Axillary Meristems (RAX) | |
| 204 | Nucleic Acid | Regulatory region of *Solanum lycopersicum* homolog of SEQ ID NO: 28 | |
| 205 | Nucleic Acid | *Solanum lycopersicum* homolog of SEQ ID NO: 28 | HG975514.1 |
| 206 | Peptide | *Solanum lycopersicum* homolog of SEQ ID NO: 28 | |
| 207 | Nucleic Acid | *Arabidopsis thaliana* ALCATRAZ | |
| 208 | Peptide | *Arabidopsis thaliana* ALCATRAZ | |
| 209 | Nucleic Acid | *Arabidopsis thaliana* VND6 | |
| 210 | Peptide | *Arabidopsis thaliana* VND6 | |
| 211 | Nucleic Acid | *Arabidopsis thaliana* VND7 | |
| 212 | Peptide | *Arabidopsis thaliana* VND7 | |
| 213 | Nucleic Acid | *Solanum lycopersicum* Adi3 | |
| 214 | Peptide | *Solanum lycopersicum* Adi3 | |
| 215 | Nucleic Acid | *Arabidopsis thaliana* XCP1 | |
| 216 | Peptide | *Arabidopsis thaliana* XCP1 | |
| 217 | Nucleic Acid | *Arabidopsis thaliana* XCP2 | |
| 218 | Peptide | *Arabidopsis thaliana* XCP2 | |
| 219 | Nucleic Acid | *Arabidopsis thaliana* Metacaspase 2d (ATMC4) | |
| 220 | Peptide | *Arabidopsis thaliana* Metacaspase 2d (ATMC4) | |
| 221 | Nucleic Acid | *Arabidopsis thaliana* disease resistance protein RPS5 | |
| 222 | Peptide | *Arabidopsis thaliana* disease resistance protein RPS5 | |
| 223 | Nucleic Acid | *Nicotiana tabacum* TMV resistance N gene | |
| 224 | Peptide | *Nicotiana tabacum* TMV resistance N gene | |
| 225 | Nucleic Acid | *Saccharum* spp. mature miRNA159 | |
| 226 | Nucleic Acid | *Nicotiana tabacum* precursor miRNA159 | |
| 227 | Nucleic Acid | *Nicotiana tabacum* mature miRNA159 | |
| 228 | Nucleic Acid | *Nicotiana* NAC089 | |
| 229 | Peptide | *Nicotiana* NAC089 | |
| 230 | Nucleic Acid | *Nicotiana* BAG6 | |
| 231 | Peptide | *Nicotiana* BAG6 | |

TABLE 1-continued

Description of sequences

| SEQ ID NO | Sequence Type | Sequence Description | NCBI Accession Number of the Top Hit of A BLAST Search |
|---|---|---|---|
| 232 | Nucleic Acid | *Nicotiana* mitogen-activated protein kinase kinase 2 (NtMEK2) | |
| 233 | Peptide | *Nicotiana* mitogen-activated protein kinase kinase 2 (NtMEK2) | |
| 234 | Nucleic Acid | *Arabidopsis thaliana* Flavin monooxygenase (YUCCA1) | |
| 235 | Peptide | *Arabidopsis thaliana* Flavin monooxygenase (YUCCA1) | |
| 236 | Nucleic Acid | *Arabidopsis thaliana* Pin-formed1 (PIN1) | |
| 237 | Peptide | *Arabidopsis thaliana* Pin-formed1 (PIN1) | |
| 238 | Nucleic Acid | *Arabidopsis thaliana* Tryptophan aminotransferase1/Transport inhibitor response2 (TAA1/TIR2) | |
| 239 | Peptide | *Arabidopsis thaliana* Tryptophan aminotransferase1/Transport inhibitor response2 (TAA1/TIR2) | |
| 240 | Nucleic Acid | *Arabidopsis thaliana* Aldehyde oxidase1 (AAO1) | |
| 241 | Peptide | *Arabidopsis thaliana* Aldehyde oxidase1 (AAO1) | |
| 242 | Nucleic Acid | *Arabidopsis thaliana* Indole-3-acetamide hydrolase1 (AMI1) | |
| 243 | Peptide | *Arabidopsis thaliana* Indole-3-acetamide hydrolase1 (AMI1) | |
| 244 | Nucleic Acid | *Nicotiana* Flavin monooxygenase (NtYUCCA-like1) | |
| 245 | Peptide | *Nicotiana* Flavin monooxygenase (NtYUCCA-like1) | |
| 246 | Nucleic Acid | *Nicotiana* Flavin monooxygenase (NtYUCCA-like2) | |
| 247 | Peptide | *Nicotiana* Flavin monooxygenase (NtYUCCA-like2) | |
| 248 | Nucleic Acid | *Nicotiana* Pin-formed1-like (NtPIN1-like) | |
| 249 | Peptide | *Nicotiana* Pin-formed1-like (NtPIN1-like) | |
| 250 | Nucleic Acid | *Nicotiana* Tryptophan aminotransferase1/Transport inhibitor response2-like (NtTAA1/TIR2-like) | |
| 251 | Peptide | *Nicotiana* Tryptophan aminotransferase1/Transport inhibitor response2-like (NtTAA1/TIR2-like) | |
| 252 | Nucleic Acid | *Nicotiana* Aldehyde oxidase1-like (NtAAO1-like) | |
| 253 | Peptide | *Nicotiana* Aldehyde oxidase1-like (NtAAO1-like) | |
| 254 | Nucleic Acid | *Nicotiana* Indole-3-acetamide hydrolase1-like (NtAMI1-like) | |
| 255 | Peptide | *Nicotiana* Indole-3-acetamide hydrolase1-like (NtAMI1-like) | |
| 256 | Peptide | 6x Histidine tag | |

BRIEF DESCRIPTION OF THE DRAWINGS

FIG. 3 shows photographs of control tobacco plants and modified tobacco plants that overexpress SEQ ID NO: 81, which encodes *Arabidopsis thaliana* BRANCHED1.

FIG. 5 shows the growth of axillary shoots in control tobacco plants and modified tobacco plants that express SEQ ID NO: 83, an RNAi construct that targets SEQ ID NO: 1 for inhibition.

FIG. 13 shows the expression pattern of Promoter P15 (SEQ ID NO: 117) fused to β-glucuronidase (GUS) in tobacco. Dark areas of GUS accumulation demonstrate where Promoter P15 is active. FIG. 13B shows GUS expression driven by Promoter P15 at the time of topping (0 hours), 7 days after topping, and 10 days after topping. At each time point, exemplary GUS staining of axillary buds from two independent modified tobacco lines is shown. FIG. 13C displays GUS staining in multiple axillary buds from individual plants at the time of topping (0 hours), 24 hours after topping, and 72 hours after topping.

FIG. 14 shows microscopy photographs displaying the activity of axillary bud-specific promoters fused to green fluorescent protein (GFP).

DETAILED DESCRIPTION

Figure 1:
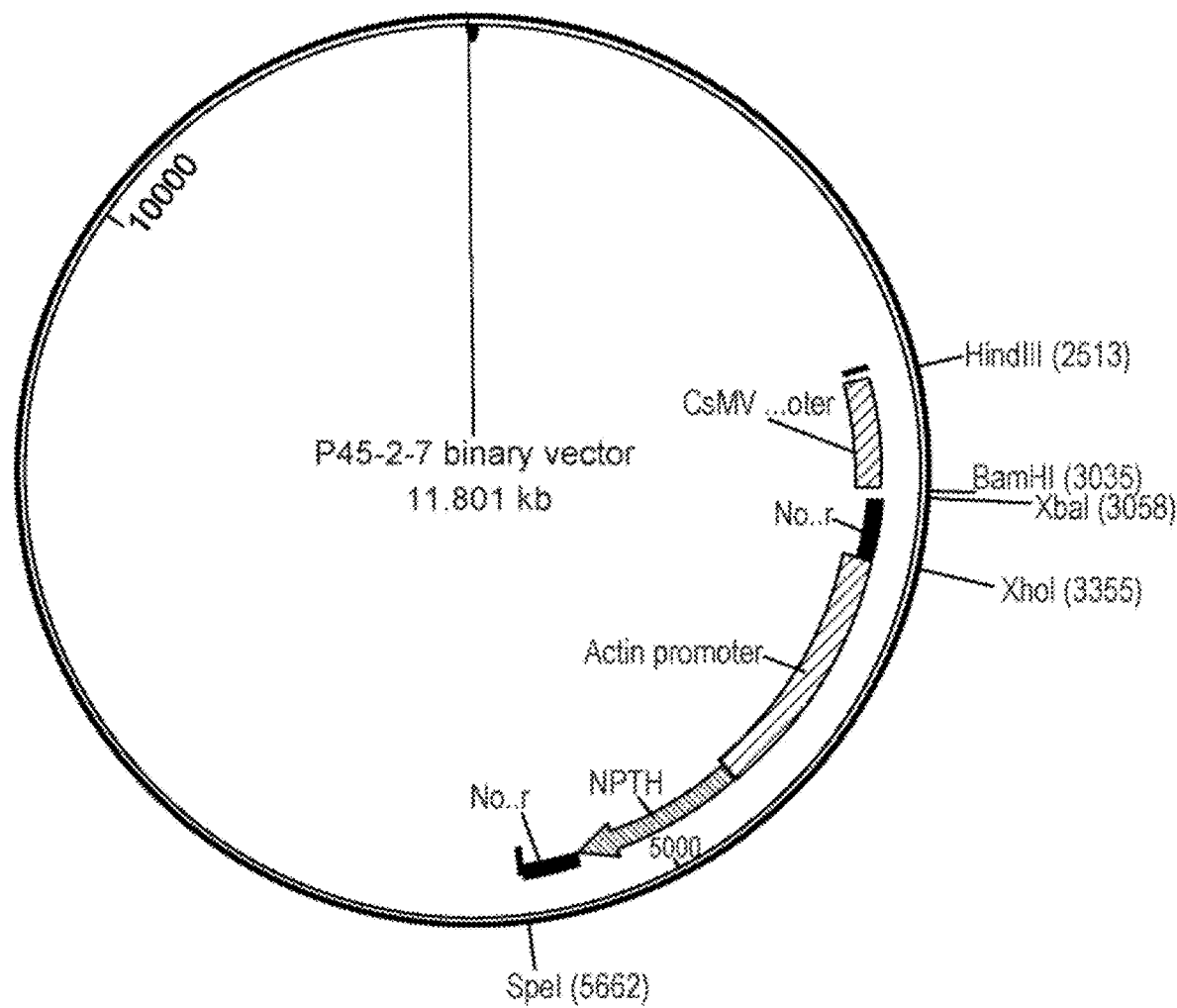
FIG. 1 is a plasmid map of binary vector p45-2-7 (SEQ ID NO: 112).

Unless defined otherwise, technical and scientific terms used herein have the same meaning as commonly understood by one of ordinary skill in the art. One skilled in the art will recognize many methods can be used in the practice of the present disclosure. Indeed, the present disclosure is in no way limited to the methods and materials described. For purposes of the present disclosure, the following terms are defined below.

Any references cited herein, including, e.g., all patents, published patent applications, and non-patent publications, are incorporated by reference in their entirety.

As used herein, the singular form "a," "an," and "the" include plural references unless the context clearly dictates otherwise. For example, the term "a compound" or "at least one compound" may include a plurality of compounds, including mixtures thereof.

The term "about" is used herein to mean approximately, roughly, around, or in the region of. When the term "about" is used in conjunction with a numerical range, it modifies that range by extending the boundaries above and below the numerical values set forth.

As used herein, a tobacco plant can be from any plant from the *Nicotiana tabacum* genus including, but not limited to *Nicotiana tabacum tabacum*; *Nicotiana tabacum amplexicaulis* PI 271989; *Nicotiana tabacum benthamiana* PI 555478; *Nicotiana tabacum bigelovii* PI 555485; *Nicotiana tabacum debneyi*; *Nicotiana tabacum excelsior* PI 224063; *Nicotiana tabacum glutinosa* PI 555507; *Nicotiana tabacum goodspeedii* PI 241012; *Nicotiana tabacum gossei* PI 230953; *Nicotiana tabacum hesperis* PI 271991; *Nicotiana tabacum knightiana* PI 555527; *Nicotiana tabacum maritima* PI 555535; *Nicotiana tabacum megalosiphon* PI 555536; *Nicotiana tabacum nudicaulis* PI 555540; *Nicotiana tabacum paniculata* PI 555545; *Nicotiana tabacum plumbaginifolia* PI 555548; *Nicotiana tabacum repanda* PI 555552; *Nicotiana tabacum rustica*; *Nicotiana tabacum suaveolens* PI 230960; *Nicotiana tabacum sylvestris* PI 555569; *Nicotiana tabacum tomentosa* PI 266379; *Nicotiana tabacum tomentosiformis*; and *Nicotiana tabacum trigonophylla* PI 555572.

In one aspect, this disclosure provides methods and compositions related to modified tobacco plants, seeds, plant components, plant cells, and products made from modified tobacco plants, seeds, plant parts, and plant cells. In one aspect, a modified seed provided herein gives rise to a modified plant provided herein. In one aspect, a modified plant, seed, plant component, plant cell, or plant genome provided herein comprises a recombinant DNA construct provided herein. In another aspect, cured tobacco material or tobacco products provided herein comprise modified tobacco plants, plant components, plant cells, or plant genomes provided herein.

As used herein, "modified" refers to plants, seeds, plant components, plant cells, and plant genomes that have been subjected to mutagenesis, genome editing, genetic transformation, or a combination thereof.

In one aspect, modified tobacco plants provided herein exhibit no or reduced suckering compared to control tobacco plants of the same variety when grown under comparable conditions. In one aspect, modified tobacco plants provided herein exhibit no or reduced topping-induced suckering compared to control tobacco plants of the same variety when grown under comparable conditions. Also provided herein are methods of producing modified tobacco plants that exhibit no or reduced suckering compared to control tobacco plants of the same variety when grown under comparable conditions. In one aspect, methods provided herein produce modified tobacco plants that exhibit no or reduced topping-induced suckering compared to control tobacco plants of the same variety when grown under comparable conditions.

As used herein, "cisgenesis" or "cisgenic" refers to genetic modification of a plant, plant cell, or plant genome in which all components (e.g., promoter, donor nucleic acid, selection gene) have only plant origins (i.e., no non-plant origin components are used). In one aspect, a modified plant, plant cell, or plant genome provided herein is cisgenic. Cisgenic plants, plant cells, and plant genomes provided herein can lead to ready-to-use tobacco lines. In another aspect, a modified tobacco plant provided herein comprises no non-tobacco genetic material or sequences.

As used herein, "suckering" refers to the development and/or growth of axillary (or lateral) buds ("suckers") from axillary meristems that grow between a leaf and the stalk. An axillary bud is an embryonic shoot that comprises an axillary meristem, surrounding leaf tissue, and surrounding stem tissue. In one aspect, suckering is induced by topping a plant.

As used herein, "topping" refers to the removal of the stalk apex, including the SAM, flowers, and up to several adjacent leaves, when a plant is near maturity. Topping a tobacco plant results in the loss of apical dominance. Prior to topping, suckering is largely kept dormant by hormonal signals emanating from the SAM; topping removes the hormonal signals and can allow the outgrowth of suckers ("topping-induced suckering"). Provided suckering is sufficiently controlled, topping increases yield, increases value-per-acre, and results in desirable modifications to physical and chemical properties of tobacco leaves.

As used herein, "comparable growth conditions" refers to similar environmental conditions and/or agronomic practices for growing and making meaningful comparisons between two or more plant genotypes so that neither environmental conditions nor agronomic practices would contribute to, or explain, any differences observed between the two or more plant genotypes. Environmental conditions include, for example, light, temperature, water, humidity, and nutrition (e.g., nitrogen and phosphorus). Agronomic practices include, for example, seeding, clipping, undercutting, transplanting, topping, and suckering. See Chapters 4B and 4C of Tobacco, Production, Chemistry and Technology, Davis & Nielsen, eds., Blackwell Publishing, Oxford (1999), pp. 70-103.

As used herein, "reduced topping-induced suckering" refers to a reduction in the number of suckers; a reduction in the size of suckers (e.g., biomass), and/or a reduction of the impact suckers have on agronomic performance (e.g., yield, quality and overall productivity of the plant) compared to a control plant when grown under comparable conditions. As used herein, a "reduction" in the number of suckers, the size of suckers, and/or the impact suckers have on agronomic performance refers to a statistically significant reduction. As used herein, "statistically significant" refers to a p-value of less than 0.05, a p-value of less than 0.025, a p-value of less than 0.01, or a p-value of less than 0.001 when using an appropriate measure of statistical significance (e.g., a one-tailed two sample t-test).

The present disclosure provides modified tobacco plants with desirable or enhanced properties, e.g., inhibited or reduced sucker growth prior to or after topping. In one aspect, a modified plant provided herein comprises fewer total suckers, smaller suckers, or both compared to a control plant lacking such modification when grown under comparable conditions. In one aspect, smaller suckers of a modified plant provided herein comprise reduced mass, reduced length, reduced diameter, or a combination thereof compared to suckers of a control plant grown under comparable conditions. The diameter of a sucker is measured at the base of the sucker where it adjoins the main stem of the plant.

In one aspect, the mass of suckers of a modified tobacco plant provided herein is at least 10%, at least 15%, at least 20%, at least 25%, at least 30%, at least 35%, at least 40%, at least 45%, at least 50%, at least 60%, at least 70%, at least 80%, at least 90%, or at least 95% reduced compared to the mass of suckers of an unmodified control tobacco plant grown under comparable conditions. In one aspect, the mass of suckers of a modified tobacco plant provided herein is reduced by 1%-25%, 1%-50%, 1%-75%, 1%-100%, 5%-25%, 5%-50%, 5%-75%, 5%-100%, 10%-25%, 10%-50%, 10%-75%, 10%-100%, 25%-50%, 25%-75%, 25%-100%, 50%-75%, or 50%-100% as compared to the mass of suckers of an unmodified control tobacco plant grown under comparable conditions. In another aspect, the length of suckers of a modified tobacco plant provided herein is at least 10%, at least 15%, at least 20%, at least 25%, at least 30%, at least 35%, at least 40%, at least 45%, at least 50%, at least 60%, at least 70%, at least 80%, at least 90%, or at least 95% reduced compared to the length of suckers of an unmodified control tobacco plant grown under comparable conditions. In one aspect, the length of suckers of a modified tobacco plant provided herein is reduced by 1%-25%, 1%-50%, 1%-75%, 1%-100%, 5%-25%, 5%-50%, 5%-75%, 5%-100%, 10%-25%, 10%-50%, 10%-75%, 10%-100%, 25%-50%, 25%-75%, 25%-100%, 50%-75%, or 50%-100% as compared to the length of suckers of an unmodified control tobacco plant grown under comparable conditions. In one aspect, the diameter of suckers of a modified tobacco plant provided herein is at least 10%, at least 15%, at least 20%, at least 25%, at least 30%, at least 35%, at least 40%, at least 45%, at least 50%, at least 60%, at least 70%, at least 80%, at least 90%, or at least 95% reduced compared to the diameter of suckers of an unmodified control tobacco plant grown under comparable conditions. In one aspect, the diameter of suckers of a modified tobacco plant provided herein is reduced by 1%-25%, 1%-50%, 1%-75%, 1%-100%, 5%-25%, 5%-50%, 5%-75%, 5%-100%, 10%-25%, 10%-50%, 10%-75%, 10%-100%, 25%-50%, 25%-75%, 25%-100%, 50%-75%, or 50%-100% as compared to the diameter of suckers of an unmodified control tobacco plant grown under comparable conditions.

In another aspect, a modified tobacco plant provided herein comprises at least 1, at least 2, at least 3, at least 4, at least 5, at least 6, at least 7, at least 8, at least 9, at least 10, at least 15, at least 20, at least 30, at least 40, at least 50, or at least 60 fewer total suckers compared to an unmodified control tobacco plant grown under comparable conditions. In another aspect, a modified tobacco plant provided herein comprises at least 10%, at least 15%, at least 20%, at least 25%, at least 30%, at least 35%, at least 40%, at least 45%, at least 50%, at least 60%, at least 70%, at least 80%, at least 90%, or at least 95% fewer suckers compared to an unmodified control tobacco plant grown under comparable conditions. In one aspect, the number of suckers of a modified tobacco plant provided herein is reduced by 1%-25%, 1%-50%, 1%-75%, 1%-100%, 5%-25%, 5%-50%, 5%-75%, 5%-100%, 10%-25%, 10%-50%, 10%-75%, 10%-100%, 25%-50%, 25%-75%, 25%-100%, 50%-75%, or 50%-100% as compared to the number of suckers of an unmodified control tobacco plant grown under comparable conditions.

Shoot apical and axillary meristems have two main functions: to maintain themselves as a group of pluripotent cells, and to generate lateral above-ground organs of the plant (e.g., stems, leaves, flowers). If a meristem fails to maintain itself, for any reason, it will eventually exhaust its pluripotent cells and cease giving rise to additional organs. In one aspect, a modified tobacco plant provided herein exhibits inhibited or eliminated axillary meristem growth; inhibited or eliminated axillary meristem maintenance; or a combination thereof compared to a control tobacco plant of the same variety when grown under comparable conditions.

In one aspect, a modified tobacco plant provided herein has similar or higher leaf yield compared to a control tobacco plant when grown under comparable conditions. In an aspect, leaf yield is selected from the group consisting of fresh yield, dry yield, and cured yield. In one aspect, a modified tobacco plant provided herein produces a leaf yield mass within about 50%, within about 45%, within about 40%, within about 35%, within about 30%, within about 25%, within about 20%, within about 15%, within about 10%, within about 5%, within about 4%, within about 3%, within about 2%, within about 1%, or within about 0.5% compared to a control tobacco plant when grown under comparable conditions. In another aspect, a modified tobacco plant provided herein produces a leaf yield mass at least 0.25%, 0.5%, 1%, 2.5%, 5%, 10%, 15%, 20%, 25%, 30%, 40%, 50%, 60%, 70%, 80%, 90%, 100%, or more than 100% higher compared to a control tobacco plant when grown under comparable conditions. In another aspect, a modified tobacco plant provided herein produces a leaf yield mass 0.25%-100%, 0.5%-100%, 1%-100%, 2.5%-100%, 5%-100%, 10%-100%, 15%-100%, 20%-100%, 25%-100%, 30%-100%, 40%-100%, 50%-100%, 60%-100%, 70%-100%, 80%-100%, 90%-100%, 100%-200%, 100%-175%, 100%-150%, 100%-125%, 0.25%-50%, 0.5%-50%, 1%-50%, 2.5%-50%, 5%-50%, 10%-50%, 15%-50%, 20%-50%, 25%-50%, 30%-50%, 40%-50%, 50%-200%, 50%-175%, 50%-150%, 50%-125%, 0.25%-25%, 0.5%-25%, 1%-25%, 2.5%-25%, 5%-25%, 10%-25%, 15%-25%, 20%-25%, 25%-200%, 25%-175%, 25%-150%, or 25%-125% higher compared to a control tobacco plant when grown under comparable conditions. In an aspect, a modified tobacco plant provided herein produces a number of leaves within 75%, within 60%, within 50%, within 45%, within 40%, within 35%, within 30%, within 25%, within 20%, within 15%, within 10%, within 5%, within 4%, within 3%, within 2%, within 1%, or within 0.5% the number of leaves produced by an unmodified control tobacco plant grown under comparable conditions.

In one aspect, a modified tobacco plant provided herein has a similar or comparable plant height compared to a control tobacco plant when grown under comparable conditions. In one aspect, a modified tobacco plant provided herein comprises a height within about 50%, within about 45%, within about 40%, within about 35%, within about 30%, within about 25%, within about 20%, within about 15%, within about 10%, within about 5%, within about 4%, within about 3%, within about 2%, within about 1%, or within about 0.5% compared to a control tobacco plants when grown under comparable conditions. In another aspect, a modified tobacco plant provided herein comprises a height 0.25%, 0.5%, 1%, 2.5%, 5%, 10%, 15%, 20%, 25%, 30%, 40%, 50%, 60%, 70%, 80%, 90%, 100%, or more than 100% taller compared to a control tobacco plant when grown under comparable conditions. In another aspect, a modified tobacco plant comprises a height 0.25%-100%, 0.5%-100%, 1%-100%, 2.5%-100%, 5%-100%, 10%-100%, 15%-100%, 20%-100%, 25%-100%, 30%-100%, 40%-100%, 50%-100%, 60%-100%, 70%-100%, 80%-100%, 90%-100%, 100%-200%, 100%-175%, 100%-150%, 100%-125%, 0.25%-50%, 0.5%-50%, 1%-50%, 2.5%-50%, 5%-50%, 10%-50%, 15%-50%, 20%-50%, 25%-50%, 30%-50%, 40%-50%, 50%-200%, 50%-175%, 50%-150%, 50%-125%, 0.25%-25%, 0.5%-25%, 1%-25%, 2.5%-25%, 5%-25%, 10%-25%, 15%-25%, 20%-25%, 25%-200%, 25%-175%, 25%-150%, or 25%-125% taller compared to a control tobacco plant when grown under comparable conditions.

In one aspect, a modified tobacco plant provided herein produces leaves that have a similar or higher USDA grade index value compared to a control tobacco plant when grown under comparable conditions. In one aspect, a modified tobacco plant provided herein produces leaves with a USDA grade index value within about 50%, within about 45%, within about 40%, within about 35%, within about 30%, within about 25%, within about 20%, within about 15%, within about 10%, within about 5%, within about 4%, within about 3%, within about 2%, within about 1%, or within about 0.5% compared to a control tobacco plant when grown under comparable conditions. In one aspect, a modified tobacco plant provided herein is capable of producing leaves having a USDA grade index value of 55 or more, 60 or more, 65 or more, 70 or more, 75 or more, 80 or more, 85 or more, 90 or more, or 95 or more. In one aspect, a modified tobacco plant provided herein produces leaves with a USDA grade index value at least 1, 2, 3, 4, 5, 6, 7, 8, 9, 10, 12, 13, 14, 15, 16, 17, 18, 19, 20, 21, 22, 23, 24, 25, 26, 27, 28, 29, 30, 35, 40, 45, 50, or more than 50 units higher compared to a control tobacco plant when grown under comparable conditions. In one aspect, a modified tobacco plant provided herein produces leaves with a USDA grade index value 1-50, 1-45, 1-40, 1-35, 1-30, 1-29, 1-28, 1-27, 1-26, 1-25, 1-24, 1-23, 1-22, 1-21, 1-20, 1-19, 1-18, 1-17, 1-16, 1-15, 1-14, 1-13, 1-12, 1-11, 1-10, 1-9, 1-8, 1-7, 1-6, 1-5, 1-4, 1-3, 1-2, 2-50, 2-45, 2-40, 2-35, 2-30, 2-29, 2-28, 2-27, 2-26, 2-25, 2-24, 2-23, 2-22, 2-21, 2-20, 2-19, 2-18, 2-17, 2-16, 2-15, 2-14, 2-13, 2-12, 2-11, 2-10, 2-9, 2-8, 2-7, 2-6, 2-5, 2-4, 2-3, 3-50, 3-45, 3-40, 3-35, 3-30, 3-29, 3-28, 3-27, 3-26, 3-25, 3-24, 3-23, 3-22, 3-21, 3-20, 3-19, 3-18, 3-17, 3-16, 3-15, 3-14, 3-13, 3-12, 3-11, 3-10, 3-9, 3-8, 3-7, 3-6, 3-5, 3-4, 4-50, 4-45, 4-40, 4-35, 4-30, 4-29, 4-28, 4-27, 4-26, 4-25, 4-24, 4-23, 4-22, 4-21, 4-20, 4-19, 4-18, 4-17, 4-16, 4-15, 4-14, 4-13, 4-12, 4-11, 4-10, 4-9, 4-8, 4-7, 4-6, 4-5, 5-50, 5-45, 5-40, 5-35, 5-30, 5-29, 5-28, 5-27, 5-26, 5-25, 5-24, 5-23, 5-22, 5-21, 5-20, 5-19, 5-18, 5-17, 5-16, 5-15, 5-14, 5-13, 5-12, 5-11, 5-10, 5-9, 5-8, 5-7, 5-6, 10-50, 10-40, 10-30, 10-20, 20-50, 20-30, 20-40, or 20-30 units higher compared to a control tobacco plant when grown under comparable conditions.

Tobacco grades are evaluated based on factors including, but not limited to, the leaf stalk position, leaf size, leaf color, leaf uniformity and integrity, ripeness, texture, elasticity, sheen (related with the intensity and the depth of coloration of the leaf as well as the shine), hygroscopicity (the faculty of the tobacco leaves to absorb and to retain the ambient moisture), and green nuance or cast. Leaf grade can be determined, for example, using an Official Standard Grade published by the Agricultural Marketing Service of the US Department of Agriculture (7 U.S.C. § 511). See, e.g., Official Standard Grades for Burley Tobacco (U.S. Type 31 and Foreign Type 93), effective Nov. 5, 1990 (55 F.R. 40645); Official Standard Grades for Flue-Cured Tobacco (U.S. Types 11, 12, 13, 14 and Foreign Type 92), effective Mar. 27, 1989 (54 F.R. 7925); Official Standard Grades for Pennsylvania Seedleaf Tobacco (U.S. Type 41), effective Jan. 8, 1965 (29 F.R. 16854); Official Standard Grades for Ohio Cigar-Leaf Tobacco (U.S. Types 42, 43, and 44), effective Dec. 8, 1963 (28 F.R. 11719 and 28 F.R. 11926); Official Standard Grades for Wisconsin Cigar-Binder Tobacco (U.S. Types 54 and 55), effective Nov. 20, 1969 (34 F.R. 17061); Official Standard Grades for Wisconsin Cigar-Binder Tobacco (U.S. Types 54 and 55), effective Nov. 20, 1969 (34 F.R. 17061); Official Standard Grades for Georgia and Florida Shade-Grown Cigar-Wrapper Tobacco (U.S. Type 62), Effective April 1971. A USDA grade index value can be determined according to an industry accepted grade index. See, e.g., Bowman et al, *Tobacco Science,* 32:39-40 (1988); Legacy Tobacco Document Library (Bates Document #523267826-523267833, Jul. 1, 1988, Memorandum on the Proposed Burley Tobacco Grade Index); and Miller et al., 1990, *Tobacco Intern.,* 192:55-57 (all foregoing references are incorporated by inference in their entirety). Alternatively, leaf grade can be determined via hyper-spectral imaging. See e.g., WO 2011/027315 (published on Mar. 10, 2011, and incorporated by inference in its entirety).

In one aspect, a modified plant provided herein requires reduced management for controlling suckering compared to a control plant when grown under comparable conditions. As used herein, "management" refers to manually removing suckers, application of chemicals (e.g., maleic hydrazide, flumetralin) to inhibit or remove suckers, or both. In one aspect, a modified plant provided herein requires reduced frequency of manual sucker removal, reduced frequency of chemical application, reduced quantities of chemical application, or a combination thereof, compared to a control plant grown under comparable conditions. See, for example, Fisher et al. "Topping, Managing Suckers, and Using Ethephon," pages 96-117 In: 2016 Flue-Cured Tobacco Information, North Carolina State University, which is herein incorporated by reference in its entirety. In one aspect, a modified plant provided herein requires manual removal of suckers 10%, 20%, 30%, 40%, 50%, 60%, 70%, 75%, 80%, 85%, 90%, or 95% as frequently as a control plant when grown under comparable conditions. In one aspect, a modified plant provided herein requires manual removal of suckers less than 10%, less than 20%, less than 30%, less than 40%, less than 50%, less than 60%, less than 70%, less than 75%, less than 80%, less than 85%, less than 90%, or less than 95% as frequently as a control plant when grown under comparable conditions. In one aspect, a modified plant provided herein requires manual removal of suckers 10%-95%, 20%-95%, 30%-95%, 40%-95%, 50%-95%, 60%-95%, 70%-95%, 80%-95%, 85%-95%, 90%-95%, 10%-50%, 20%-50%, 30%-50%, 40%-50%, 10%-20%, 10%-30%, 10%-40%, 10%-50%, 10%-60%, 10%-70%, 10%-80%, 10%-85%, or 10%-90% as frequently as a control plant when grown under comparable conditions. In one aspect, a modified plant provided herein requires chemical application to control suckering 10%, 20%, 30%, 40%, 50%, 60%, 70%, 75%, 80%, 85%, 90%, or 95% as frequently as a control plant when grown under comparable conditions. In one aspect, a modified plant provided herein requires chemical application to control suckering less than 10%, less than 20%, less than 30%, less than 40%, less than 50%, less than 60%, less than 70%, less than 75%, less than 80%, less than 85%, less than 90%, or less than 95% as frequently as a control plant when grown under comparable conditions. In one aspect, a modified plant provided herein requires chemical application to control suckering 10%-95%, 20%-95%, 30%-95%, 40%-95%, 50%-95%, 60%-95%, 70%-95%, 80%-95%, 85%-95%, 90%-95%, 10%-50%, 20%-50%, 30%-50%, 40%-50%, 10%-20%, 10%-30%, 10%-40%, 10%-50%, 10%-60%, 10%-70%, 10%-80%, 10%-85%, or 10%-90% as frequently as a control plant grown under comparable conditions. In one aspect, a modified plant provided herein requires a chemical spray volume of 10%, 20%, 30%, 40%, 50%, 60%, 70%, 75%, 80%, 85%, 90%, or 95% of the volume used to control suckering of a control plant when grown under comparable conditions. In one aspect, a modified plant provided herein requires a chemical spray volume of less than 10%, less than 20%, less than 30%, less than 40%, less than 50%, less than 60%, less than 70%, less than 75%, less than 80%, less than 85%, less than 90%, or less than 95% of the volume used to control suckering of a control plant when grown under comparable conditions. In one aspect, a modified plant provided herein requires a chemical spray volume 10%-95%, 20%-95%, 30%-95%, 40%-95%, 50%-95%, 60%-95%, 70%-95%, 80%-95%, 85%-95%, 90%-95%, 10%-50%, 20%-50%, 30%-50%, 40%-50%, 10%-20%, 10%-30%, 10%-40%, 10%-50%, 10%-60%, 10%-70%, 10%-80%, 10%-85%, 10%-90% less than a control plant when grown under comparable conditions.

Unless specified otherwise, measurements of sucker length, sucker mass, number of suckers, leaf yield, or leaf grade index values mentioned herein for a tobacco plant, variety, cultivar, or line refer to average measurements, including, for example, an average of multiple leaves (e.g., 2, 3, 4, 5, 6, 7, 8, 9, 10, 11, 12, 13, 14, 15, 16, 17, 18, 19, or 20 or more leaves) of a single plant or an average measurement from a population of tobacco plants from a single variety, cultivar, or line. A population of tobacco plants or a collection of tobacco leaves for determining an average measurement (e.g., fresh weight or leaf grading) can be of any size, for example, 5, 10, 15, 20, 25, 30, 35, 40, or 50. Industry-accepted standard protocols are followed for determining average measurements or grade index values.

In one aspect, a modified plant or leaf has a similar leaf chemistry profile compared to a control plant when grown under comparable conditions. Without being limiting, a leaf chemistry profile can comprise the amount of alkaloids (e.g., nicotine, nornicotine, anabasine, anatabine), malic acid, and reducing sugars (e.g., dextrose), or a combination thereof in a tobacco plant or tobacco leaf. In one aspect, a modified plant or leaf provided herein comprises a total alkaloids level within about 50%, within about 45%, within about 40%, within about 35%, within about 30%, within about 25%, within about 20%, within about 15%, within about 10%, within about 5%, within about 4%, within about 3%, within about 2%, within about 1%, or within about 0.5% of the total alkaloids level of a control plant when grown under comparable conditions. In one aspect, a modified plant or leaf provided herein comprises a nicotine level within about 50%, within about 45%, within about 40%, within about 35%, within about 30%, within about 25%, within about 20%, within about 15%, within about 10%, within about 5%, within about 4%, within about 3%, within about 2%, within about 1%, or within about 0.5% of the nicotine level of a control plant when grown under comparable conditions. In one aspect, a modified plant or leaf provided herein comprises a nornicotine level within about 50%, within about 45%, within about 40%, within about 35%, within about 30%, within about 25%, within about 20%, within about 15%, within about 10%, within about 5%, within about 4%, within about 3%, within about 2%, within about 1%, or within about 0.5% of the nornicotine level of a control plant when grown under comparable conditions. In one aspect, a modified plant or leaf provided herein comprises an anabasine level within about 50%, within about 45%, within about 40%, within about 35%, within about 30%, within about 25%, within about 20%, within about 15%, within about 10%, within about 5%, within about 4%, within about 3%, within about 2%, within about 1%, or within about 0.5% of the anabasine level of a control plant when grown under comparable conditions. In one aspect, a modified plant or leaf provided herein comprises an anatabine level within about 50%, within about 45%, within about 40%, within about 35%, within about 30%, within about 25%, within about 20%, within about 15%, within about 10%, within about 5%, within about 4%, within about 3%, within about 2%, within about 1%, or within about 0.5% of the anatabine level of a control plant when grown under comparable conditions. In one aspect, a modified plant or leaf provided herein comprises a malic acid level within about 50%, within about 45%, within about 40%, within about 35%, within about 30%, within about 25%, within about 20%, within about 15%, within about 10%, within about 5%, within about 4%, within about 3%, within about 2%, within about 1%, or within about 0.5% of the malic acid level of a control plant when grown under comparable conditions. In one aspect, a modified plant or leaf provided herein comprises a reducing sugars level within about 50%, within about 45%, within about 40%, within about 35%, within about 30%, within about 25%, within about 20%, within about 15%, within about 10%, within about 5%, within about 4%, within about 3%, within about 2%, within about 1%, or within about 0.5% of the reducing sugars level of a control plant when grown under comparable conditions. In one aspect, a modified plant or leaf provided herein comprises a dextrose level within about 50%, within about 45%, within about 40%, within about 35%, within about 30%, within about 25%, within about 20%, within about 15%, within about 10%, within about 5%, within about 4%, within about 3%, within about 2%, within about 1%, or within about 0.5% of the dextrose level of a control plant when grown under comparable conditions.

In one aspect, a modified plant or leaf provided herein comprises no or reduced suckers compared to a control plant and further comprises a nicotine level at least 50%, at least 60%, at least 70%, at least 80%, at least 85%, at least 90%, at least 91%, at least 92%, at least 93%, at least 94%, at least 95%, at least 96%, at least 97%, at least 98%, at least 99%, at least 99.5%, or at least 99.9% lower than the nicotine level of a control plant when grown under comparable conditions.

In one aspect, a plant component provided herein includes, but is not limited to, a leaf, a stem, a root, a seed, a flower, pollen, an anther, an ovule, a pedicel, a fruit, a meristem, a cotyledon, a hypocotyl, a pod, an embryo, endosperm, an explant, a callus, a tissue culture, a shoot, a cell, and a protoplast. In further aspects, this disclosure provides tobacco plant cells, tissues, and organs that are not reproductive material and do not mediate the natural reproduction of the plant. In another aspect, this disclosure also provides tobacco plant cells, tissues, and organs that are reproductive material and mediate the natural reproduction of the plant. In another aspect, this disclosure provides tobacco plant cells, tissues, and organs that cannot maintain themselves via photosynthesis. In another aspect, this disclosure provides somatic tobacco plant cells. Somatic cells, contrary to germline cells, do not mediate plant reproduction.

Provided cells, tissues and organs can be from seed, fruit, leaf, cotyledon, hypocotyl, meristem, embryos, endosperm, root, shoot, stem, pod, flower, inflorescence, stalk, pedicel, style, stigma, receptacle, petal, sepal, pollen, anther, filament, ovary, ovule, pericarp, phloem, and vascular tissue. In another aspect, this disclosure provides a tobacco plant chloroplast. In a further aspect, this disclosure provides an epidermal cell, a stomata cell, a leaf hair (trichome), a root hair, or a storage root. In another aspect, this disclosure provides a tobacco protoplast.

Skilled artisans understand that tobacco plants naturally reproduce via seeds, not via asexual reproduction or vegetative propagation. In one aspect, this disclosure provides tobacco endosperm. In another aspect, this disclosure provides a tobacco endosperm cell. In a further aspect, this disclosure provides a male or female sterile tobacco plant, which cannot reproduce without human intervention.

In one aspect, a modified plant, seed, plant part, or plant cell provided herein comprises one or more non-naturally occurring mutations. In one aspect, a mutation provided herein suppresses suckering in a plant. In another aspect, a mutation provided herein suppresses topping-induced suckering in a plant. In still another aspect, a mutation provided herein suppresses suckering in a plant prior to topping. Types of mutations provided herein include, for example, substitutions (point mutations), deletions, insertions, duplications, and inversions. Such mutations are desirably present in the coding region of a gene; however, mutations in a promoter or other regulatory region, an intron, an intron-exon boundary, or an untranslated region of a gene may also be desirable.

In one aspect, methods provided herein are capable of producing a tobacco plant with reduced suckering using mutagenesis. Mutagenesis methods include, without limitation, chemical mutagenesis, for example, treatment of seeds with ethyl methylsulfate (EMS) (Hildering and Verkerk, In, The use of induced mutations in plant breeding. Pergamon Press, pp. 317-320, 1965); or UV-irradiation, X-rays, electron beams, ion beams (e.g., carbon ion beam, helium ion beam, neon ion beam), and fast neutron irradiation (see, for example, Verkerk, *Neth. J. Agric. Sci.* 19:197-203, 1971; Poehlman, Breeding Field Crops, Van Nostrand Reinhold, New York (3.sup.rd ed.), 1987; and Tanaka, *J. Radiat. Res.* 51:223-233, 2010); transposon tagging (Fedoroff et al., 1984; U.S. Pat. Nos. 4,732,856 and 5,013,658); and T-DNA insertion methodologies (Hoekema et al., 1983; U.S. Pat. No. 5,149,645). EMS-induced mutagenesis consists of chemically inducing random point mutations over the length of a genome. Fast neutron mutagenesis consists of exposing seeds to neutron bombardment which causes large deletions through double stranded DNA breakage. Transposon tagging comprises inserting a transposon within an endogenous gene to reduce or eliminate expression of the gene.

In addition, a fast and automatable method for screening for chemically induced mutations, TILLING (Targeting Induced Local Lesions In Genomes), using denaturing HPLC or selective endonuclease digestion of selected PCR products is also applicable to the present disclosure. See, McCallum et al. (2000) *Nat. Biotechnol.* 18:455-457. Mutations that impact gene expression or that interfere with the function of genes provided herein can be determined using methods that are well known in the art. Insertional mutations in gene exons usually result in null-mutants. Mutations in conserved residues can be particularly effective in inhibiting the function of a protein.

The screening and selection of mutagenized tobacco plants can be through any methodologies known to those having ordinary skill in the art. Examples of screening and selection methodologies include, but are not limited to, Southern analysis, PCR amplification for detection of a polynucleotide, Northern blots, RNase protection, primer-extension, RT-PCR amplification for detecting RNA transcripts, Sanger sequencing, Next Generation sequencing technologies (e.g., Illumina, PacBio, Ion Torrent, 454) enzymatic assays for detecting enzyme or ribozyme activity of polypeptides and polynucleotides, and protein gel electrophoresis, Western blots, immunoprecipitation, and enzyme-linked immunoassays to detect polypeptides. Other techniques such as in situ hybridization, enzyme staining, and immunostaining also can be used to detect the presence or expression of polypeptides and/or polynucleotides. Methods for performing all of the referenced techniques are known.

In one aspect, a polynucleotide provided herein comprises at least 1, at least 2, at least 3, at least 4, at least 5, at least 6, at least 7, at least 8, at least 9, at least 10, or more than 10 mutations compared to a naturally existing polynucleotide. In another aspect, a mutation provided herein is positioned within a polynucleotide selected from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83-160, 186, 188, 190, 192, 194, 196, 198, 200, 202, 204, 205, 207, 209, 211, 213, 215, 217, 219, 221, 223, 225-228, 230, 232, 234, 236, 238, 240, 242, 244, 246, 248, 250, 252, and 254. In one aspect, a mutation provided herein is positioned within a polynucleotide encoding a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

In one aspect, a plant genome provided herein is mutated (edited) by a nuclease selected from the group consisting of a meganuclease, a zinc-finger nuclease (ZFN), a transcription activator-like effector nuclease (TALEN), a CRISPR/Cas9 nuclease, or a CRISPR/Cpf1 nuclease. In another aspect, a plant genome provided herein is mutated by a CRISPR/CasX or a CRISPR/CasY nuclease. As used herein, "editing" or "genome editing" refers to targeted mutagenesis of at least 1, at least 2, at least 3, at least 4, at least 5, at least 6, at least 7, at least 8, at least 9, or at least 10 nucleotides of an endogenous plant genome nucleic acid sequence, or removal or replacement of an endogenous plant genome nucleic acid sequence. In one aspect, an edited nucleic acid sequence provided herein has at least 99.9%, at least 99.5%, at least 99%, at least 98%, at least 97%, at least 96%, at least 95%, at least 94%, at least 93%, at least 92%, at least 91%, at least 90%, at least 85%, at least 80%, or at least 75% sequence identity with an endogenous nucleic acid sequence. In one aspect, an edited nucleic acid sequence provided herein has at least 99.9%, at least 99.5%, at least 99%, at least 98%, at least 97%, at least 96%, at least 95%, at least 94%, at least 93%, at least 92%, at least 91%, at least 90%, at least 85%, at least 80%, or at least 75% sequence identity with a polynucleotide selected from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83-160, 186, 188, 190, 192, 194, 196, 198, 200, 202, 204, 205, 207, 209, 211, 213, 215, 217, 219, 221, 223, 225-228, 230, 232, 234, 236, 238, 240, 242, 244, 246, 248, 250, 252, 254, and fragments thereof. In another aspect, an edited nucleic acid sequence provided herein has at least 99.9%, at least 99.5%, at least 99%, at least 98%, at least 97%, at least 96%, at least 95%, at least 94%, at least 93%, at least 92%, at least 91%, at least 90%, at least 85%, at least 80%, or at least 75% sequence identity with a polynucleotide encoding a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

In one aspect, a nuclease provided herein is used to edit a plant genomic locus encoding a sequence having at least 70%, at least 75%, at least 80%, at least 85%, at least 90%, at least 95%, at least 96%, at least 97%, at least 98%, at least 99% or 100% sequence identity to a polynucleotide selected from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83-160, 186, 188, 190, 192, 194, 196, 198, 200, 202, 204, 205, 207, 209, 211, 213, 215, 217, 219, 221, 223, 225-228, 230, 232, 234, 236, 238, 240, 242, 244, 246, 248, 250, 252, 254, and fragments thereof.

In another aspect, a nuclease provided herein is used to edit a plant genomic locus encoding a polypeptide having at least 70%, at least 75%, at least 80%, at least 85%, at least 90%, at least 95%, at least 96%, at least 97%, at least 98%, at least 99% or 100% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255. In another aspect, a nuclease provided herein is used to edit a plant genome locus encoding a polypeptide having at least 70%, at least 75%, at least 80%, at least 85%, at least 90%, at least 95%, at least 96%, at least 97%, at least 98%, at least 99% or 100% sequence similarity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

Meganucleases, ZFNs, TALENs, CRISPR/Cas9, and CRISPR/Cpf1 induce a double-strand DNA break at a target site of a genomic sequence that is then repaired by the natural processes of homologous recombination (HR) or non-homologous end-joining (NHEJ). Sequence modifications then occur at the cleaved sites, which can include deletions or insertions that result in gene disruption in the case of NHEJ, or integration of donor nucleic acid sequences by HR. In one aspect, a methods provided herein comprises editing a plant genome with a nuclease provided herein to mutate at least 1, at least 2, at least 3, at least 4, at least 5, at least 6, at least 7, at least 8, at least 9, at least 10, or more than 10 nucleotides in the plant genome via HR with a donor polynucleotide. In one aspect, a mutation provided herein is caused by genome editing using a nuclease. In another aspect, a mutation provided herein is caused by non-homologous end-joining or homologous recombination.

Meganucleases, which are commonly identified in microbes, are unique enzymes with high activity and long recognition sequences (>14 bp) resulting in site-specific digestion of target DNA. Engineered versions of naturally occurring meganucleases typically have extended DNA recognition sequences (for example, 14 to 40 bp).

In one aspect, a meganuclease provided herein edits a polynucleotide having at least 70%, at least 75%, at least 80%, at least 85%, at least 90%, at least 95%, at least 96%, at least 97%, at least 98%, at least 99% or 100% sequence identity to a polynucleotide selected from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83-160, 186, 188, 190, 192, 194, 196, 198, 200, 202, 204, 205, 207, 209, 211, 213, 215, 217, 219, 221, 223, 225-228, 230, 232, 234, 236, 238, 240, 242, 244, 246, 248, 250, 252, 254, and fragments thereof. In another aspect, a meganuclease provided herein edits a polynucleotide encoding a polypeptide having at least 70%, at least 75%, at least 80%, at least 85%, at least 90%, at least 95%, at least 96%, at least 97%, at least 98%, at least 99% or 100% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255. In another aspect, a meganuclease provided herein edits a polynucleotide encoding a polypeptide having at least 70%, at least 75%, at least 80%, at least 85%, at least 90%, at least 95%, at least 96%, at least 97%, at least 98%, at least 99% or 100% sequence similarity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

The engineering of meganucleases can be more challenging than that of ZFNs and TALENs because the DNA recognition and cleavage functions of meganucleases are intertwined in a single domain. Specialized methods of mutagenesis and high-throughput screening have been used to create novel meganuclease variants that recognize unique sequences and possess improved nuclease activity.

ZFNs are synthetic proteins consisting of an engineered zinc finger DNA-binding domain fused to the cleavage domain of the FokI restriction endonuclease. ZFNs can be designed to cleave almost any long stretch of double-stranded DNA for modification of the zinc finger DNA-binding domain. ZFNs form dimers from monomers composed of a non-specific DNA cleavage domain of FokI endonuclease fused to a zinc finger array engineered to bind a target DNA sequence.

The DNA-binding domain of a ZFN is typically composed of 3-4 zinc-finger arrays. The amino acids at positions −1, +2, +3, and +6 relative to the start of the zinc finger co-helix, which contribute to site-specific binding to the target DNA, can be changed and customized to fit specific target sequences. The other amino acids form the consensus backbone to generate ZFNs with different sequence specificities. Rules for selecting target sequences for ZFNs are known in the art.

The FokI nuclease domain requires dimerization to cleave DNA and therefore two ZFNs with their C-terminal regions are needed to bind opposite DNA strands of the cleavage site (separated by 5-7 bp). The ZFN monomer can cute the target site if the two-ZF-binding sites are palindromic. The term ZFN, as used herein, is broad and includes a monomeric ZFN that can cleave double stranded DNA without assistance from another ZFN. The term ZFN is also used to refer to one or both members of a pair of ZFNs that are engineered to work together to cleave DNA at the same site.

Without being limited by any scientific theory, because the DNA-binding specificities of zinc finger domains can in principle be re-engineered using one of various methods, customized ZFNs can theoretically be constructed to target nearly any gene sequence. Publicly available methods for engineering zinc finger domains include Context-dependent Assembly (CoDA), Oligomerized Pool Engineering (OPEN), and Modular Assembly.

In one aspect, a ZFN provided herein edits a polynucleotide having at least 70%, at least 75%, at least 80%, at least 85%, at least 90%, at least 95%, at least 96%, at least 97%, at least 98%, at least 99% or 100% sequence identity to a polynucleotide selected from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83-160, 186, 188, 190, 192, 194, 196, 198, 200, 202, 204, 205, 207, 209, 211, 213, 215, 217, 219, 221, 223, 225-228, 230, 232, 234, 236, 238, 240, 242, 244, 246, 248, 250, 252, 254, and fragments thereof. In another aspect, a ZFN provided herein edits a polynucleotide encoding a polypeptide having at least 70%, at least 75%, at least 80%, at least 85%, at least 90%, at least 95%, at least 96%, at least 97%, at least 98%, at least 99% or 100% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255. In another aspect, a ZFN provided herein edits a polynucleotide encoding a polypeptide having at least 70%, at least 75%, at least 80%, at least 85%, at least 90%, at least 95%, at least 96%, at least 97%, at least 98%, at least 99% or 100% sequence similarity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

TALENs are artificial restriction enzymes generated by fusing the transcription activator-like effector (TALE) DNA binding domain to a FokI nuclease domain. When each member of a TALEN pair binds to the DNA sites flanking a target site, the FokI monomers dimerize and cause a double-stranded DNA break at the target site.

The term TALEN, as used herein, is broad and includes a monomeric TALEN that can cleave double stranded DNA without assistance from another TALEN. The term TALEN is also used to refer to one or both members of a pair of TALENs that work together to cleave DNA at the same site.

Transcription activator-like effectors (TALEs) can be engineered to bind practically any DNA sequence. TALE proteins are DNA-binding domains derived from various plant bacterial pathogens of the genus *Xanthomonas*. The X pathogens secrete TALEs into the host plant cell during infection. The TALE moves to the nucleus, where it recognizes and binds to a specific DNA sequence in the promoter region of a specific DNA sequence in the promoter region of a specific gene in the host genome. TALE has a central DNA-binding domain composed of 13-28 repeat monomers of 33-34 amino acids. The amino acids of each monomer are highly conserved, except for hypervariable amino acid residues at positions 12 and 13. The two variable amino acids are called repeat-variable diresidues (RVDs). The amino acid pairs NI, NG, HD, and NN of RVDs preferentially recognize adenine, thymine, cytosine, and guanine/adenine, respectively, and modulation of RVDs can recognize consecutive DNA bases. This simple relationship between amino acid sequence and DNA recognition has allowed for the engineering of specific DNA binding domains by selecting a combination of repeat segments containing the appropriate RVDs.

Besides the wild-type FokI cleavage domain, variants of the FokI cleavage domain with mutations have been designed to improve cleavage specificity and cleavage activity. The FokI domain functions as a dimer, requiring two constructs with unique DNA binding domains for sites in the target genome with proper orientation and spacing. Both the number of amino acid residues between the TALEN DNA binding domain and the FokI cleavage domain and the number of bases between the two individual TALEN binding sites are parameters for achieving high levels of activity.

The relationship between amino acid sequence and DNA recognition of the TALE binding domain allows for designable proteins. Software programs such as DNA Works can be used to design TALE constructs. Other methods of designing TALE constructs are known to those of skill in the art. See Doyle et al., *Nucleic Acids Research* (2012) 40: W117-122; Cermak et al., *Nucleic Acids Research* (2011). 39: e82; and tale-nt.cac.cornell.edu/about.

In one aspect, a TALEN provided herein edits a polynucleotide having at least 70%, at least 75%, at least 80%, at least 85%, at least 90%, at least 95%, at least 96%, at least 97%, at least 98%, at least 99% or 100% sequence identity to a polynucleotide selected from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83-160, 186, 188, 190, 192, 194, 196, 198, 200, 202, 204, 205, 207, 209, 211, 213, 215, 217, 219, 221, 223, 225-228, 230, 232, 234, 236, 238, 240, 242, 244, 246, 248, 250, 252, 254, and fragments thereof. In another aspect, a TALEN provided herein edits a polynucleotide encoding a polypeptide having at least 70%, at least 75%, at least 80%, at least 85%, at least 90%, at least 95%, at least 96%, at least 97%, at least 98%, at least 99% or 100% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255. In another aspect, a TALEN provided herein edits a polynucleotide encoding a polypeptide having at least 70%, at least 75%, at least 80%, at least 85%, at least 90%, at least 95%, at least 96%, at least 97%, at least 98%, at least 99% or 100% sequence similarity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

A CRISPR/Cas9 system or a CRISPR/Cpf1 system are alternatives to the FokI-based methods ZFN and TALEN. The CRISPR systems are based on RNA-guided engineered nucleases that use complementary base pairing to recognize DNA sequences at target sites.

CRISPR/Cas9 systems are part of the adaptive immune system of bacteria and archaea, protecting them against invading nucleic acids such as viruses by cleaving the foreign DNA in a sequence-dependent manner. The immunity is acquired by the integration of short fragments of the invading DNA known as spacers between two adjacent repeats at the proximal end of a CRISPR locus. The CRISPR arrays, including the spacers, are transcribed during subsequent encounters with invasive DNA and are processed into small interfering CRISPR RNAs (crRNAs) approximately 40 nt in length, which combine with the trans-activating CRISPR RNA (tracrRNA) to activate and guide the Cas9 nuclease. This cleaves homologous double-stranded DNA sequences known as protospacers in the invading DNA. A prerequisite for cleavage is the presence of a conserved protospacer-adjacent motif (PAM) downstream of the target DNA, which usually has the sequence 5-NGG-3 but less frequently NAG. Specificity is provided by the so-called "seed sequence" approximately 12 bases upstream of the PAM, which must match between the RNA and target DNA. Cpf1 acts in a similar manner to Cas9, but Cpf1 does not require a tracrRNA.

In one aspect, an engineered guide RNA provided herein guides a Cas9 or Cpf1 nuclease to a polynucleotide having at least 70%, at least 75%, at least 80%, at least 85%, at least 90%, at least 95%, at least 96%, at least 97%, at least 98%, at least 99% or 100% sequence identity to a polynucleotide selected from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83-160, 186, 188, 190, 192, 194, 196, 198, 200, 202, 204, 205, 207, 209, 211, 213, 215, 217, 219, 221, 223, 225-228, 230, 232, 234, 236, 238, 240, 242, 244, 246, 248, 250, 252, 254, and fragments thereof. In another aspect, an engineered guide RNA provided herein guides a Cas9 or Cpf1 nuclease to a polynucleotide encoding a polypeptide having at least 70%, at least 75%, at least 80%, at least 85%, at least 90%, at least 95%, at least 96%, at least 97%, at least 98%, at least 99% or 100% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255. In another aspect, an engineered guide RNA provided herein guides a Cas9 or Cpf1 nuclease to a polynucleotide encoding a polypeptide having at least 70%, at least 75%, at least 80%, at least 85%, at least 90%, at least 95%, at least 96%, at least 97%, at least 98%, at least 99% or 100% sequence similarity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

In one aspect, a Cas9 or a Cpf1 nuclease provided herein cleaves a polynucleotide having at least 70%, at least 75%, at least 80%, at least 85%, at least 90%, at least 95%, at least 96%, at least 97%, at least 98%, at least 99% or 100% sequence identity to a polynucleotide selected from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83-160, 186, 188, 190, 192, 194, 196, 198, 200, 202, 204, 205, 207, 209, 211, 213, 215, 217, 219, 221, 223, 225-228, 230, 232, 234, 236, 238, 240, 242, 244, 246, 248, 250, 252, 254, and fragments thereof. In another aspect, a Cas9 or a Cpf1 nuclease provided herein cleaves a polynucleotide encoding a polypeptide having at least 70%, at least 75%, at least 80%, at least 85%, at least 90%, at least 95%, at least 96%, at least 97%, at least 98%, at least 99% or 100% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255. In another aspect, a Cas9 or a Cpf1 nuclease provided herein cleaves a polynucleotide encoding a polypeptide having at least 70%, at least 75%, at least 80%, at least 85%, at least 90%, at least 95%, at least 96%, at least 97%, at least 98%, at least 99% or 100% sequence similarity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

In one aspect, a mutagenesis system provided herein (e.g., chemical mutagenesis, irradiation mutagenesis, transposon mutagenesis, *Agrobacterium*-mediated transformation, a meganuclease, a ZFN, a TALEN, a CRISPR/Cas9 system, a CRISPR/Cpf1 system), or a combination of mutagenesis systems provided herein, is used in a method to introduce one or more mutations to a tobacco gene that is natively expressed in at least one tobacco axillary meristem cell.

In still another aspect, a modified tobacco plant provided herein further comprises one or more mutations in one or more loci encoding a nicotine demethylase (e.g., CYP82E4, CYP82E5, CYP82E10) that confer reduced amounts of nornicotine (See U.S. Pat. Nos. 8,319,011; 8,124,851; 9,187,759; 9,228,194; 9,228,195; 9,247,706) compared to control plant lacking one or more mutations in one or more loci encoding a nicotine demethylase. In another aspect, a tobacco plant provided herein further comprises one or more mutations in a Nic1 locus, a Nic2 locus, or both, which confer reduced amounts of nicotine compared to a control plant lacking one or more mutations in a Nic1 locus, a Nic2 locus, or both.

In one aspect, recombinant DNA constructs or expression cassettes provided herein comprise a promoter selected from the group consisting of a constitutive promoter, an inducible promoter, and a tissue-preferred promoter (for example, without being limiting, a leaf-specific promoter, a root-specific promoter, or a meristem-specific promoter).

In one aspect, a promoter provided herein is an axillary bud-specific promoter. In one aspect, a promoter provided herein is an axillary meristem-specific promoter. In one aspect, an axillary meristem-specific promoter provided herein is functional or preferentially functional in an L1 layer, an L2 layer, an L3 layer, or a combination thereof. Dicot shoot apical and axillary meristems comprise three distinct cell layers: the L1 layer (outermost layer), the L2 layer (middle layer), and the L3 layer (innermost layer). The L1 and L2 layers make up the tunica, and they divide anticlinally (the division plane is perpendicular to the surface of the meristem). The L3 layer, or corpus, divides in all directions. The L1 layer eventually gives rise to epidermal tissue; the L2 layer gives rise to ground tissue (e.g., parenchyma, collenchyma, sclerenchyma); and the L3 layer typically gives rise to vascular tissue (e.g., xylem, phloem)

Shoot apical and axillary meristems can also be divided into three zones: a central zone, a peripheral zone, and a rib zone. Cells from the central zone, comprising parts of the L1, L2, and L3 layers at the peak of the meristem, serve to organize and maintain the meristem; the central zone comprises pluripotent stem cells. The peripheral zone surrounds the central zone and will form organs (e.g., leaf primordia, flower primordia) and undergo morphogenesis; this zone comprises high mitotic activity. The rib zone, or rib meristem, is positioned below the central zone; the rib zone gives rise to stem and vasculature tissue. In one aspect, an axillary meristem-specific promoter provided herein is functional or preferentially functional in a central zone, a peripheral zone, a rib zone, or a combination thereof.

In one aspect, an axillary bud-specific promoter comprises a polynucleotide sequence having at least 60%, at least 70%, at least 75%, at least 80%, at least 85%, at least 90%, at least 95%, at least 96%, at least 97%, at least 98%, at least 99% or 100% sequence identity to a polynucleotide selected from the group consisting of SEQ ID NOs: 113-118, 148-160, 204 and fragments thereof. In another aspect, an axillary meristem-specific promoter comprises a polynucleotide sequence having at least 60%, at least 70%, at least 75%, at least 80%, at least 85%, at least 90%, at least 95%, at least 96%, at least 97%, at least 98%, at least 99% or 100% sequence identity to a polynucleotide selected from the group consisting of SEQ ID NOs: 113-118, 148-160, 204 and fragments thereof. In still another aspect, a promoter active in an L1 layer, an L2 layer, an L3 layer, or a combination thereof comprises a polynucleotide sequence selected from the group consisting of SEQ ID NOs: 113-118, 148-160, 204 and a fragment thereof. In another aspect, a promoter active in a central zone, a peripheral zone, a rib zone, or a combination thereof comprises a polynucleotide sequence selected from the group consisting of SEQ ID NOs: 113-118, 148-160, 204 and a fragment thereof. In one aspect, a promoter fragment provided herein has a length of at least 50, at least 75, at least 100, at least 200, at least 300, at least 400, at least 500, at least 600, at least 700, at least 800, at least 900, at least 1000, at least 1250, at least 1500, at least 1750, at least 2000, at least 2500, at least 3000, at least 3500, at least 4000, at least 4500, or at least 4999 nucleotides. In another aspect, a promoter fragment provided herein has a length of between 50 and 200, between 100 and 200, between 100 and 300, between 100 and 400, between 100 and 500, between 100 and 600, between 100 and 700, between 100 and 800, 100 and 900, between 100 and 1000, between 100 and 2000, between 200 and 300, between 200 and 400, between 200 and 500, between 200 and 600, between 200 and 700, between 200 and 800, between 200 and 900, between 200 and 1000, between 200 and 2000, between 200 and 2500, between 200 and 3000, between 500 and 1000, between 500 and 1500, between 500 and 2000, between 500 and 2500, between 500 and 3000, between 1000 and 2000, between 1000 and 3000, between 1500 and 2000, between 1500 and 2500, between 1500 and 3000, between 2000 and 3000 nucleotides, between 100 and 3500, between 100 and 4000, between 100 and 4500, between 100 and 4999, between 500 and 3500, between 500 and 4000, between 500 and 4500, between 500 and 4999, between 1000 and 3500, between 1000 and 4000, between 1000 and 4500, between 1000 and 4999, between 2000 and 3500, between 2000 and 4000, between 2000 and 4500, between 2000 and 4999, between 3000 and 3500, between 3000 and 4000, between 3000 and 4500, between 3000 and 4999, between 3500 and 4000, between 3500 and 4500, between 3500 and 4999, between 4000 and 4500, between 4000 and 4999, or between 4500 and 4999 nucleotides.

In one aspect, a recombinant DNA construct of the present disclosure comprises a polynucleotide selected from the group consisting of SEQ ID NOs: 113-118, 148-160, 204 and a fragment thereof operably linked to a polynucleotide encoding a polypeptide having at least 70%, at least 75%, at least 80%, at least 85%, at least 90%, at least 95%, at least 96%, at least 97%, at least 98%, at least 99% or 100% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

In one aspect, a recombinant DNA construct of the present disclosure comprises a polynucleotide selected from the group consisting of SEQ ID NOs: 113-118, 148-160, 204 and a fragment thereof operably linked to a polynucleotide encoding a polypeptide having at least 70%, at least 75%, at least 80%, at least 85%, at least 90%, at least 95%, at least 96%, at least 97%, at least 98%, at least 99% or 100% sequence similarity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

In one aspect, a recombinant DNA construct of the present disclosure comprises a polynucleotide selected from the group consisting of SEQ ID NOs: 113-118, 148-160, 204 and a fragment thereof operably linked to a polynucleotide having at least 60%, at least 65%, at least 70%, at least 75%, at least 80%, at least 85%, at least 90%, at least 95%, at least 96%, at least 97%, at least 98%, at least 99% or 100% identity to a polynucleotide selected from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83-160, 186, 188, 190, 192, 194, 196, 198, 200, 202, 204, 205, 207, 209, 211, 213, 215, 217, 219, 221, 223, and 225-228, 230, 232, 234, 236, 238, 240, 242, 244, 246, 248, 250, 252, 254, and fragments thereof.

In one aspect, a tobacco plant, or part thereof, of the present disclosure comprises a heterologous promoter having at least 90% sequence identity to a polynucleotide selected from the group consisting of SEQ ID NOs: 113-118, 148-160, 204, and fragments thereof operably linked to a polynucleotide encoding an auxin biosynthesis protein or an auxin transport protein.

Exemplary constitutive promoters include the core promoter of the Rsyn7 promoter and other constitutive promoters disclosed in U.S. Pat. No. 6,072,050; the core CaMV 35S promoter (Odell et al. (1985) Nature 313:810-812); ubiquitin (Christensen et al. (1989) Plant Mol. Biol. 12:619-632 and Christensen et al. (1992) Plant Mol. Biol. 18:675-689); pEMU (Last et al. (1991) Theor. Appl. Genet. 81:581-588); MAS (Velten et al. (1984) EMBO J 3:2723-2730); ALS promoter (U.S. Pat. No. 5,659,026), and the like.

Exemplary chemical-inducible promoters include the tobacco PR-1a promoter, which is activated by salicylic acid. Other chemical-inducible promoters of interest include steroid-responsive promoters (see, for example, the glucocorticoid-inducible promoter in Schena et al. (1991) Proc. Natl. Acad. Sci. USA 88:10421-10425 and McNellis et al. (1998) Plant J. 14(2):247-257) and tetracycline-inducible promoters (see, for example, Gatz et al. (1991) Mol. Gen. Genet. 227:229-237, and U.S. Pat. Nos. 5,814,618 and 5,789,156). Additional exemplary promoters that can be used herein are those responsible for heat-regulated gene expression, light-regulated gene expression (for example, the pea rbcS-3A;

the maize rbcS promoter; the chlorophyll a1b-binding protein gene found in pea; or the Arabssu promoter), hormone-regulated gene expression (for example, the abscisic acid (ABA) responsive sequences from the Em gene of wheat; the ABA-inducible HVA1 and HVA22, and rd29A promoters of barley and *Arabidopsis*; and wound-induced gene expression (for example, of wunl), organ specific gene expression (for example, of the tuber-specific storage protein gene; the 23-kDa zein gene from maize described by; or the French bean (β-phaseolin gene), or pathogen-inducible promoters (for example, the PR-1, prp-1, or (β-1,3 glucanase promoters, the fungal-inducible wirla promoter of wheat, and the nematode-inducible promoters, TobRB7-5A and Hmg-1, of tobacco arid parsley, respectively).

Additional exemplary tissue-preferred promoters include those disclosed in Yamamoto et al. (1997) Plant J. 12(2): 255-265; Kawamata et al. (1997) Plant Cell Physiol. 38(7): 792-803; Hansen et al. (1997) Mol. Gen. Genet. 254(3):337-343; Russell et al. (1997) Transgenic Res. 6(2):157-168; Rinehart et al. (1996) Plant Physiol. 112(3):1331-1341; Van Camp et al. (1996) Plant Physiol. 112(2):525-535; Canevascini et al. (1996) Plant Physiol. 112(2):513-524; Yamamoto et al. (1994) Plant Cell Physiol. 35(5):773-778; Lam (1994) Results Probl. Cell Differ. 20:181-196; Orozco et al. (1993) Plant Mol. Biol. 23(6):1129-1138; Matsuoka et al. (1993) Proc Natl. Acad. Sci. USA 90(20):9586-9590; and Guevara-Garcia et al. (1993) Plant J. 4(3):495-505.

As used herein, "operably linked" refers to a functional linkage between two or more elements. For example, an operable linkage between a polynucleotide of interest and a regulatory sequence (e.g., a promoter) is a functional link that allows for expression of the polynucleotide of interest. Operably linked elements may be contiguous or non-contiguous. In one aspect, a promoter provided herein is operably linked to a polynucleotide selected from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83-160, 186, 188, 190, 192, 194, 196, 198, 200, 202, 204, 205, 207, 209, 211, 213, 215, 217, 219, 221, 223, 225-228, 230, 232, 234, 236, 238, 240, 242, 244, 246, 248, 250, 252, 254, and fragments thereof. In another aspect, a promoter provided herein is operably linked to a polynucleotide encoding a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

As used herein, "heterologous" refers to a sequence that originates from a foreign species, or, if from the same species, is substantially modified from its native form in composition and/or genomic locus by deliberate human intervention. The term also is applicable to nucleic acid constructs, also referred to herein as "polynucleotide constructs" or "nucleotide constructs." In this manner, a "heterologous" nucleic acid construct is intended to mean a construct that originates from a foreign species, or, if from the same species, is substantially modified from its native form in composition and/or genomic locus by deliberate human intervention. Heterologous nucleic acid constructs include, but are not limited to, recombinant nucleotide constructs that have been introduced into a plant or plant part thereof, for example, via transformation methods or subsequent breeding of a transgenic plant with another plant of interest.

In one aspect, a modified plant, seed, plant component, plant cell, or plant genome provided herein comprises a heterologous promoter operably linked to a polynucleotide encoding a polypeptide having at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255. In another aspect, a recombinant DNA construct provided herein comprises a heterologous promoter operably linked to a polynucleotide encoding a polypeptide having at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

Enhancer elements are regions of DNA that can be bound by proteins to activate RNA transcription. In one aspect, a promoter sequence provided herein is operably linked to an enhancer element. In another aspect, a polynucleotide selected from the group consisting of SEQ ID NOs: 113-118, 148-160, 204, and a fragment thereof is operably linked to an enhancer element. In one aspect, an enhancer element provided herein is at least 10, at least 25, at least 50, at least 75, at least 100, at least 150, at least 200, at least 250, at least 300, at least 350, at least 400, at least 450, at least 500, at least 550, at least 600, at least 650, at least 700, at least 750, at least 800, at least 850, at least 900, at least 950, at least 1000, at least 1100, at least 1200, at least 1300, at least 1400, at least 1500, at least 1750, at least 2000, at least 2500, at least 3000, at least 3500, at least 4000, at least 4500, or at least 5000 nucleotides in length. In one aspect, an enhancer element provided herein is a CsVMV promoter.

Many gene promoters contain cis-regulatory elements that function to regulate gene transcription. Cis-regulatory elements often function by serving as binding sites for transcription factors. In one aspect, a promoter provided herein comprises at least 1, at least 2, at least 3, at least 4, at least 5, or at least 6 cis regulatory elements selected from the group consisting of a bud dormancy element (BDE), an axillary bud growth UP1 element, an axillary bud growth UP2 element, a sucrose responsive element (SRE), a sugar repressive element (SURE), and a bud activation or TCP-binding element (BAE). In another aspect, a recombinant nucleotide provided herein comprises a promoter, where the promoter comprises at least 1, at least 2, at least 3, at least 4, at least 5, or at least 6 cis elements selected from the group consisting of a bud dormancy element (BDE), an axillary bud growth UP1 element, an axillary bud growth UP2 element, a sucrose responsive element (SURE), a sugar repressive element (SRE), and a bud activation or TCP-binding element (BAE).

In one aspect, a promoter provided herein comprises at least 1, at least 2, at least 3, at least 4, at least 5, or at least 6 cis-regulatory elements within 1, 3, 5, 10, 15, 20, 25, 30, 35, 40, 45, 50, 75, 100, 200, 300, 400, 500, 600, 700, 800, 900, 1000, 1100, 1200, 1300, 1400, 1500, 1600, 1700, 1800, 1900, 2000, 2100, 2200, 2300, 2400, 2500, 2600, 2700, 2800, 2900, 3000, 3100, 3200, 3300, 3400, 3500, 3600, 3700, 3800, 3900, 4000, 4100, 4200, 4300, 4400, 4500, 4600, 4700, 4800, 4900, 5000, 7500, or 10,000 nucleotides of a transcriptional start site. In another aspect, a promoter provided herein comprises at least 1, at least 2, at least 3, at least 4, at least 5, or at least 6 cis-regulatory elements within 1-10,000, 1-7500, 1-5000, 1-4900, 1-4800, 1-4700, 1-4600, 1-4500, 1-4400, 1-4300, 1-4200, 1-4100, 1-4000, 1-3900, 1-3800, 1-3700, 1-3600, 1-3500, 1-3400, 1-3300, 1-3200, 1-3100, 1-3000, 1-2900, 1-2800, 1-2700, 1-2600, 1-2500, 1-2400, 1-2300, 1-2200, 1-2100, 1-2000, 1-1900, 1-1800, 1-1700, 1-1600, 1-1500, 1-1400, 1-1300, 1-1200, 1-1100, 1-1000, 1-900, 1-800, 1-700, 1-600, 1-500, 1-400, 1-300, 1-200, 1-100, 1-75, 1-50, 1-45, 1-40, 1-35, 1-30, 1-25, 1-20, 1-15, 5-10,000, 5-7500, 5-5000, 5-4900, 5-4800, 5-4700, 5-4600, 5-4500, 5-4400, 5-4300, 5-4200, 5-4100, 5-4000, 5-3900, 5-3800, 5-3700, 5-3600, 5-3500, 5-3400, 5-3300, 5-3200, 5-3100, 5-3000, 5-2900, 5-2800, 5-2700, 5-2600, 5-2500, 5-2400, 5-2300, 5-2200, 5-2100, 5-2000, 5-1900, 5-1800, 5-1700, 5-1600, 5-1500, 5-1400, 5-1300, 5-1200, 5-1100, 5-1000, 5-900, 5-800, 5-700, 5-600, 5-500, 5-400, 5-300, 5-200, 5-100, 5-75, 5-50, 5-45, 5-40, 5-35, 5-30, 5-25, 5-20, 20-10,000, 20-7500, 20-5000, 20-4900, 20-4800, 20-4700, 20-4600, 20-4500, 20-4400, 20-4300, 20-4200, 20-4100, 20-4000, 20-3900, 20-3800, 20-3700, 20-3600, 20-3500, 20-3400, 20-3300, 20-3200, 20-3100, 20-3000, 20-2900, 20-2800, 20-2700, 20-2600, 20-2500, 20-2400, 20-2300, 20-2200, 20-2100, 20-2000, 20-1900, 20-1800, 20-1700, 20-1600, 20-1500, 20-1400, 20-1300, 20-1200, 20-1100, 20-1000, 20-900, 20-800, 20-700, 20-600, 20-500, 20-400, 20-300, 20-200, 20-100, 20-75, 20-50, 20-45, 20-40, 20-35, 20-30, 20-25, 50-10,000, 50-7500, 50-5000, 50-4900, 50-4800, 50-4700, 50-4600, 50-4500, 50-4400, 50-4300, 50-4200, 50-4100, 50-4000, 50-3900, 50-3800, 50-3700, 50-3600, 50-3500, 50-3400, 50-3300, 50-3200, 50-3100, 50-3000, 50-2900, 50-2800, 50-2700, 50-2600, 50-2500, 50-2400, 50-2300, 50-2200, 50-2100, 50-2000, 50-1900, 50-1800, 50-1700, 50-1600, 50-1500, 50-1400, 50-1300, 50-1200, 50-1100, 50-1000, 50-900, 50-800, 50-700, 50-600, 50-500, 50-400, 50-300, 50-200, 50-100, 50-75, 100-10,000, 100-7500, 100-5000, 100-4900, 100-4800, 100-4700, 100-4600, 100-4500, 100-4400, 100-4300, 100-4200, 100-4100, 100-4000, 100-3900, 100-3800, 100-3700, 100-3600, 100-3500, 100-3400, 100-3300, 100-3200, 100-3100, 100-3000, 100-2900, 100-2800, 100-2700, 100-2600, 100-2500, 100-2400, 100-2300, 100-2200, 100-2100, 100-2000, 100-1900, 100-1800, 100-1700, 100-1600, 100-1500, 100-1400, 100-1300, 100-1200, 100-1100, 100-1000, 100-900, 100-800, 100-700, 100-600, 100-500, 100-400, 100-300, 100-200, 500-10,000, 500-7500, 500-5000, 500-4900, 500-4800, 500-4700, 500-4600, 500-4500, 500-4400, 500-4300, 500-4200, 500-4100, 500-4000, 500-3900, 500-3800, 500-3700, 500-3600, 500-3500, 500-3400, 500-3300, 500-3200, 500-3100, 500-3000, 500-2900, 500-2800, 500-2700, 500-2600, 500-2500, 500-2400, 500-2300, 500-2200, 500-2100, 500-2000, 500-1900, 500-1800, 500-1700, 500-1600, 500-1500, 500-1400, 500-1300, 500-1200, 500-1100, 500-1000, 500-900, 500-800, 500-700, or 500-600 nucleotides of a transcriptional start site.

In one aspect, a promoter provided herein is functional in an axillary bud cell and comprises at least 1, at least 2, at least 3, at least 4, at least 5, or at least 6 cis-regulatory elements selected from the group consisting of a bud dormancy element (BDE), an axillary bud growth UP1 element, an axillary bud growth UP2 element, a sucrose responsive element (SURE), a sugar repressive element (SRE), and a bud activation or TCP-binding element (BAE).

Also provided herein are the transformation of tobacco plants with recombinant constructs or expression cassettes described herein using any suitable transformation methods known in the art. Methods for introducing polynucleotide sequences into tobacco plants are known in the art and include, but are not limited to, stable transformation methods, transient transformation methods, and virus-mediated methods. "Stable transformation" refers to transformation where the nucleotide construct of interest introduced into a plant integrates into a genome of the plant and is capable of being inherited by the progeny thereof. "Transient transformation" is intended to mean that a sequence is introduced into the plant and is only temporally expressed or is only transiently present in the plant.

In one aspect, methods and compositions provided herein comprise the introduction of one or more polynucleotides into one or more plant cells. In one aspect, a plant genome provided herein is modified to include an introduced polynucleotide or recombinant DNA construct. As used herein, "plant genome" refers to a nuclear genome, a mitochondrial genome, or a plastid (e.g., chloroplast) genome of a plant cell. In another aspect, a polynucleotide provided herein is integrated into an artificial chromosome. In one aspect, an artificial chromosome comprising a polynucleotide provided herein is integrated into a plant cell.

In one aspect, a modified plant, seed, plant component, plant cell, or plant genome provided herein comprises one or more transgenes. In one aspect, a transgene provided herein suppresses suckering in a plant. In another aspect, a transgene provided herein suppresses topping-induced suckering in a plant. In still another aspect, a transgene provided herein suppresses suckering in a plant prior to topping. As used herein, a "transgene" refers to a polynucleotide that has been transferred into a genome by any method known in the art. In one aspect, a transgene is an exogenous polynucleotide. In one aspect, a transgene is an endogenous polynucleotide that is integrated into a new genomic locus where it is not normally found.

In one aspect, transgenes provided herein comprise a recombinant DNA construct. In one aspect, recombinant DNA constructs or expression cassettes provided herein can comprise a selectable marker gene for the selection of transgenic cells. Selectable marker genes include, but are not limited to, genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones, triazolopyrimidines, sulfonylurea (e.g., chlorsulfuron and sulfometuron methyl), and 2,4-dichlorophenoxyacetate (2,4-D). Additional selectable markers include phenotypic markers such as β-galactosidase and fluorescent proteins such as green fluorescent protein (GFP).

In one aspect, methods and compositions provided herein comprise a vector. As used herein, the terms "vector" or "plasmid" are used interchangeably and refer to a circular, double-stranded DNA molecule that is physically separate from chromosomal DNA. In one aspect, a plasmid or vector used herein is capable of replication in vivo. A "transformation vector," as used herein, is a plasmid that is capable of transforming a plant cell. In an aspect, a plasmid provided herein is a bacterial plasmid. In another aspect, a plasmid provided herein is an *Agrobacterium* Ti plasmid or derived from an *Agrobacterium* Ti plasmid.

In one aspect, a plasmid or vector provided herein is a recombinant vector. As used herein, the term "recombinant vector" refers to a vector formed by laboratory methods of genetic recombination, such as molecular cloning. In another aspect, a plasmid provided herein is a synthetic plasmid. As used herein, a "synthetic plasmid" is an artificially created plasmid that is capable of the same functions (e.g., replication) as a natural plasmid (e.g., Ti plasmid). Without being limited, one skilled in the art can create a synthetic plasmid de novo via synthesizing a plasmid by individual nucleotides, or by splicing together nucleic acid molecules from different pre-existing plasmids.

Vectors are commercially available or can be produced by recombinant DNA techniques routine in the art. In one aspect, a vector provided herein comprises all or part of SEQ ID NO: 112. A vector containing a nucleic acid can have expression elements operably linked to such a nucleic acid, and further can include sequences such as those encoding a selectable marker (e.g., an antibiotic resistance gene). A vector containing a nucleic acid can encode a chimeric or fusion polypeptide (i.e., a polypeptide operatively linked to a heterologous polypeptide, which can be at either the N-terminus or C-terminus of the polypeptide). Representative heterologous polypeptides are those that can be used in purification of the encoded polypeptide (e.g., 6×His tag (SEQ ID NO: 256), glutathione S-transferase (GST)).

Suitable methods of introducing polynucleotides (e.g., transgenes, recombinant vectors, recombinant DNA constructs, expression constructs) into plant cells of the present disclosure include microinjection (Crossway et al. (1986) *Biotechniques* 4:320-334), electroporation (Shillito et al. (1987) *Meth. Enzymol.* 153:313-336; Riggs et al. (1986) *Proc. Natl. Acad. Sci. USA* 83:5602-5606), *Agrobacterium*-mediated transformation (U.S. Pat. Nos. 5,104,310, 5,149,645, 5,177,010, 5,231,019, 5,463,174, 5,464,763, 5,469,976, 4,762,785, 5,004,863, 5,159,135, 5,563,055, and 5,981,840), direct gene transfer (Paszkowski et al. (1984) *EMBO J.* 3:2717-2722), and ballistic particle acceleration (see, for example, U.S. Pat. Nos. 4,945,050, 5,141,131, 5,886,244, 5,879,918, and 5,932,782; Tomes et al. (1995) in *Plant Cell, Tissue, and Organ Culture Fundamental Methods*, ed. Gamborg and Phillips (Springer-Verlag, Berlin); McCabe et al. (1988) *Biotechnology* 6:923-926). Also see Weissinger et al. (1988) *Ann. Rev. Genet.* 22:421-477; Christou et al. (1988) *Plant Physiol.* 87:671-674 (soybean); McCabe et al. (1988) *Bio/Technology* 6:923-926 (soybean); Finer and McMullen (1991) *In Vitro Cell Dev. Biol.* 27P: 175-182 (soybean); Singh et al. (1998) *Theor. Appl. Genet.* 96:319-324 (soybean); De Wet et al. (1985) in *The Experimental Manipulation of Ovule Tissues*, ed. Chapman et al. (Longman, N.Y.), pp. 197-209 (pollen); Kaeppler et al. (1990) *Plant Cell Reports* 9:415-418 and Kaeppler et al. (1992) *Theor. Appl. Genet.* 84:560-566 (whisker-mediated transformation); D'Halluin et al. (1992) *Plant Cell* 4:1495-1505 (electroporation). In one aspect, a bacterial cell provided herein comprises a recombinant DNA construct or recombinant vector provided herein.

In another aspect, recombinant constructs or expression cassettes provided herein may be introduced into plants by contacting plants with a virus or viral nucleic acids. Generally, such methods involve incorporating an expression cassette of the present disclosure within a viral DNA or RNA molecule. It is recognized that promoters for use in the expression cassettes provided herein also encompass promoters utilized for transcription by viral RNA polymerases. Methods for introducing polynucleotides into plants and expressing a protein encoded therein, involving viral DNA or RNA molecules, are known in the art. See, for example, U.S. Pat. Nos. 5,889,191, 5,889,190, 5,866,785, 5,589,367, 5,316,931, and Porta et al. (1996) *Molecular Biotechnology* 5:209-221.

Any plant tissue that can be subsequently propagated using clonal methods, whether by organogenesis or embryogenesis, may be transformed with a recombinant construct or an expression cassette provided herein. By "organogenesis" in intended the process by which shoots and roots are developed sequentially from meristematic centers. By "embryogenesis" is intended the process by which shoots and roots develop together in a concerted fashion (not sequentially), whether from somatic cells or gametes. Exemplary tissues that are suitable for various transformation protocols described herein include, but are not limited to, callus tissue, existing meristematic tissue (e.g., apical meristems, axillary buds, and root meristems) and induced meristem tissue (e.g., cotyledon meristem and hypocotyl meristem), hypocotyls, cotyledons, leaf disks, pollen, embryos, and the like.

In one aspect, this disclosure provides a plant or seed comprising a recombinant polynucleotide, where the recombinant polynucleotide comprises a promoter that is functional in an L1 layer, an L2 layer, an L3 region, a rib zone, a central zone, a peripheral zone, or any combination thereof, which is operably linked to a structural nucleic acid molecule comprising a nucleic acid sequence, where the nucleic acid sequence encodes a polypeptide having at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

In one aspect, an auxin biosynthesis protein or an auxin transport protein is selected from the group consisting of SEQ ID NOs: 235, 237, 239, 241, 243, 245, 247, 249, 251, 253, and 255. In another aspect, an auxin biosynthesis protein or an auxin transport protein comprises at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence identity to a polypeptide selected from the group consisting of SEQ ID NOs: 235, 237, 239, 241, 243, 245, 247, 249, 251, 253, and 255. In another aspect, an auxin biosynthesis protein or an auxin transport protein comprises at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence similarity to a polypeptide selected from the group consisting of SEQ ID NOs: 235, 237, 239, 241, 243, 245, 247, 249, 251, 253, and 255. In one aspect, an auxin biosynthesis protein or an auxin transport protein is encoded by a nucleic acid sequence, where the nucleic acid sequence encodes a polypeptide having at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence identity to a polypeptide elected from the group consisting of SEQ ID NOs: 235, 237, 239, 241, 243, 245, 247, 249, 251, 253, and 255.

In one aspect, an auxin biosynthesis protein or an auxin transport protein is encoded by a polynucleotide selected from the group consisting of SEQ ID NOs: 234, 236, 238, 240, 242, 244, 246, 248, 250, 252, and 254. In one aspect, an auxin biosynthesis protein or an auxin transport protein is encoded by a polynucleotide having at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identity to a polynucleotide selected from the group consisting of SEQ ID NOs: 234, 236, 238, 240, 242, 244, 246, 248, 250, 252, and 254.

In one aspect, this disclosure provides a plant or seed comprising a recombinant polynucleotide, where the recombinant polynucleotide comprises a promoter that is functional in an L1 layer, an L2 layer, an L3 region, a rib zone, a central zone, a peripheral zone, or a combination thereof, which is operably linked to a structural nucleic acid molecule comprising a nucleic acid sequence, where the nucleic acid sequence encodes an auxin biosynthesis protein or an auxin transport protein.

In another aspect, this disclosure provides a recombinant DNA construct comprising a promoter that is functional in an L1 layer, an L2 layer, an L3 region, a rib zone, a central zone, a peripheral zone, or a combination thereof; and a heterologous and operably linked nucleic acid sequence, where the nucleic acid sequence encodes a non-coding RNA or a polypeptide. In another aspect, this disclosure provides a recombinant DNA construct comprising a promoter that is functional in an L1 later, an L2 layer, an L3 region, a rib zone, a central zone, a peripheral zone, or a combination thereof; and a heterologous and operably linked nucleic acid sequence, where the nucleic acid sequence encodes an auxin biosynthesis protein or an auxin transport protein.

In one aspect, this disclosure provides a recombinant DNA construct comprising a heterologous axillary meristem-specific promoter operably linked to a polynucleotide that encodes an auxin biosynthesis protein or an auxin transport protein.

In one aspect, this disclosure provides a method of reducing or eliminating topping-induced suckering in a tobacco plant comprising transforming a tobacco plant with a recombinant DNA construct comprising a promoter expressing in an L1 layer, an L2 layer, an L3 region, a rib zone, a central zone, a peripheral zone, or a combination thereof. In another aspect, this disclosure provides a method comprising transforming a tobacco plant with a recombinant DNA construct comprising a heterologous promoter that is functional in an L1 layer, an L2 layer, an L3 region, a rib zone, a central zone, a peripheral zone, or a combination thereof, and is operably linked to a polynucleotide that is transcribed into an RNA molecule that suppresses the level of an endogenous gene, and where the endogenous gene promotes or is required for axillary meristem growth, axillary meristem maintenance, or both.

In one aspect, this disclosure provides a method for controlling topping-induced suckering in a plant comprising transforming the plant with a recombinant DNA construct, where the recombinant DNA construct comprises a promoter that is operably linked to a polynucleotide encoding a polypeptide having at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

In one aspect, this disclosure provides a method for controlling topping-induced suckers in a plant comprising transforming said plant with a recombinant DNA construct, wherein said recombinant DNA construct comprises a promoter that is operably linked to a polynucleotide encoding an auxin biosynthesis protein or an auxin transport protein.

It is understood that any modified tobacco plant of the present disclosure can further comprise additional agronomically desirable traits, for example, by transformation with a genetic construct or transgene using a technique known in the art. Without limitation, an example of a desired trait is herbicide resistance, pest resistance, disease resistance, high yield, high grade index value, curability, curing quality, mechanical harvestability, holding ability, leaf quality, height, plant maturation (e.g., early maturing, early to medium maturing, medium maturing, medium to late maturing, or late maturing), stalk size (e.g., a small, medium, or a large stalk), or leaf number per plant (e.g., a small (e.g., 5-10 leaves), medium (e.g., 11-15 leaves), or large (e.g., 16-21) number of leaves), or any combination. In one aspect, reduced suckering tobacco plants or seeds provided herein comprise one or more transgenes expressing one or more insecticidal proteins, such as, for example, a crystal protein of *Bacillus thuringiensis* or a vegetative insecticidal protein from *Bacillus cereus*, such as VIP3 (see, for example, Estruch et al. (1997) *Nat. Biotechnol.* 15:137). In another aspect, tobacco plants provided herein further comprise an introgressed trait conferring resistance to brown stem rot (U.S. Pat. No. 5,689,035) or resistance to cyst nematodes (U.S. Pat. No. 5,491,081).

The level and/or activity of polypeptides provided herein may be modulated by employing a polynucleotide that is not capable of directing, in a transformed plant, the expression of a protein or an RNA. For example, the polynucleotides of the invention may be used to design polynucleotide constructs that can be employed in methods for altering or mutating a genomic nucleotide sequence in an organism. Such polynucleotide constructs include, but are not limited to, RNA:DNA vectors, RNA:DNA mutational vectors, RNA:DNA repair vectors, mixed-duplex oligonucleotides, self-complementary RNA:DNA oligonucleotides and recombinogenic oligonucleobases. Such nucleotide constructs and methods of use are known in the art. See, U.S. Pat. Nos. 5,565,350; 5,731,181; 5,756,325; 5,760,012; 5,795,972 and 5,871,984; each of which is incorporated herein by reference as if set forth in its entirety. See also, International Patent Application Publication Nos. WO 98/149350, WO 99/107865 and WO 99/125921; and Beetham et al. (1999) Proc. Natl. Acad. Sci. USA 96:8774-8778; each of which is incorporated herein by reference as if set forth in its entirety.

The present disclosure provides compositions and methods for inhibiting the expression or function of one or more polypeptides selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255 in a plant, particularly plants of the *Nicotiana tabacum* genus, including tobacco plants of various commercial varieties.

In one aspect, inhibition of the expression of one or more polypeptides provided herein may be obtained by RNA interference (RNAi) by expression of a polynucleotide provided herein. In one aspect, RNAi comprises expressing a non-coding RNA. As used herein, a "non-coding RNA" is selected from the group consisting of a microRNA (miRNA), a small interfering RNA (siRNA), a trans-acting siRNA (ta-siRNA), a transfer RNA (tRNA), a ribosomal RNA (rRNA), an intron, a hairpin RNA (hpRNA), and an intron-containing hairpin RNA (ihpRNA). In one aspect, a single non-coding RNA provided herein inhibits the expression of at least 1, at least 2, at least 3, at least 4, at least 5, at least 6, at least 7, at least 8, at least 9, at least 10, or more than 10 polypeptides. In one aspect, a non-coding RNA provided herein is stably transformed into a plant genome. In another aspect, a non-coding RNA provided herein is transiently transformed into a plant genome.

In one aspect, this disclosure provides RNA molecules useful for inhibiting the expression or function or one or more polypeptides selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255. In one aspect, an RNA molecule provided herein is a non-coding RNA.

In another aspect, the recombinant DNA construct encodes a double stranded RNA. Also provided are modified tobacco plants or part thereof, cured tobacco material, or tobacco products comprising these recombinant DNA constructs. In one aspect, these transgenic plants, cured tobacco material, or tobacco products comprise reduced suckering compared to a control tobacco plant without the recombinant DNA construct. Further provided are methods of reducing sucker growth of a tobacco plant, the method comprising transforming a tobacco plant with any of these recombinant DNA constructs.

In one aspect, a tobacco plant or part thereof provided herein comprises a heterologous promoter operably linked to a polynucleotide that encodes a non-coding RNA molecule, where the non-coding RNA molecule is capable of binding to an RNA encoding a polypeptide having at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 161-185, 187, 189, 191, 193, 195, 197, 199, 224, 229, 231, 233, 245, 247, 249, 251, 253, and 255, and where the non-coding RNA molecule suppresses the expression of the polypeptide.

As used herein, the terms "suppress," "inhibit," "inhibition," and "inhibiting" are defined as any method known in the art or described herein that decreases the expression or function of a gene product of interest (e.g., an mRNA, a protein, a non-coding RNA). "Inhibition" can be in the context of a comparison between two plants, for example, a modified plant versus a control plant. Alternatively, inhibition of expression or function of a target gene product can be in the context of a comparison between plant cells, organelles, organs, tissues, or plant components within the same plant or between different plants, and includes comparisons between developmental or temporal stages within the same plant or plant component or between plants or plant components. "Inhibition" includes any relative decrement of function or production of a gene product of interest, up to and including complete elimination of function or production of that gene product. The term "inhibition" encompasses any method or composition that down-regulates translation and/or transcription of the target gene product or functional activity of the target gene product.

The term "inhibitory sequence" encompasses any polynucleotide or polypeptide sequence capable of inhibiting the expression or function of a gene in a plant, such as full-length polynucleotide or polypeptide sequences, truncated polynucleotide or polypeptide sequences, fragments of polynucleotide or polypeptide sequences, variants of polynucleotide or polypeptide sequences, sense-oriented nucleotide sequences, antisense-oriented nucleotide sequences, the complement of a sense- or antisense-oriented nucleotide sequence, inverted regions of nucleotide sequences, hairpins of nucleotide sequences, double-stranded nucleotide sequences, single-stranded nucleotide sequences, combinations thereof, and the like. The term "polynucleotide sequence" includes sequences of RNA, DNA, chemically modified nucleic acids, nucleic acid analogs, combinations thereof, and the like.

Inhibitory sequences are designated herein by the name of the target gene product. Thus, as a non-limiting example, an "NTH15 inhibitory sequence" refers to an inhibitory sequence that is capable of inhibiting the expression of an NTH15 locus in a plant, for example, at the level of transcription and/or translation, or which is capable of inhibiting the function of a gene product. When the phrase "capable of inhibiting" is used in the context of a polynucleotide inhibitory sequence, it is intended to mean that the inhibitory sequence itself exerts the inhibitory effect; or, where the inhibitory sequence encodes an inhibitory nucleotide molecule (for example, hairpin RNA, miRNA, or double-stranded RNA polynucleotides), or encodes an inhibitory polypeptide (e.g., a polypeptide that inhibits expression or function of the target gene product), following its transcription (for example, in the case of an inhibitory sequence encoding a hairpin RNA, miRNA, or double-stranded RNA polynucleotide) or its transcription and translation (in the case of an inhibitory sequence encoding an inhibitory polypeptide), the transcribed or translated product, respectively, exerts the inhibitory effect on the target gene product (e.g., inhibits expression or function of the target gene product).

An inhibitory sequence provided herein can be a sequence triggering gene silencing via any silencing pathway or mechanism known in the art, including, but not limited to, sense suppression/co-suppression, antisense suppression, double-stranded RNA (dsRNA) interference, hairpin RNA interference and intron-containing hairpin RNA interference, amplicon-mediated interference, ribozymes, small interfering RNA, artificial or synthetic microRNA, and artificial trans-acting siRNA. An inhibitory sequence may range from at least about 20 nucleotides, at least about 50 nucleotides, at least about 70 nucleotides, at least about 100 nucleotides, at least about 150 nucleotides, at least about 200 nucleotides, at least about 250 nucleotides, at least about 300 nucleotides, at least about 350 nucleotides, at least about 400 nucleotides, and up to the full-length polynucleotide encoding the proteins of the present disclosure, depending upon the desired outcome. In one aspect, an inhibitory sequence can be a fragment of between about 50 and about 400 nucleotides, between about 70 and about 350 nucleotides, between about 90 and about 325 nucleotides, between about 90 and about 300 nucleotides, between about 90 and about 275 nucleotides, between about 100 and about 400 nucleotides, between about 100 and about 350 nucleotides, between about 100 and about 325 nucleotides, between about 100 and about 300 nucleotides, between about 125 and about 300 nucleotides, or between about 125 and about 275 nucleotides in length.

In one aspect, the present disclosure provides a recombinant DNA construct comprising a promoter that is functional in a tobacco cell and operably linked to a polynucleotide that encodes an RNA molecule capable of binding to an RNA encoding a polypeptide having an amino acid sequence at least 60%, at least 70%, at least 75%, at least 80%, at least 85%, at least 90%, at least 95%, at least 96%, at least 97%, at least 98%, at least 99%, or 100% identical to an amino acid sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 70, 72, 74, 76, 78, 161-185, 187, 189, 191, 197, 199, 224, 229, 231, 233, 235, 237, 239, 241, 243, 245, 247, 249, 251, 253, 255, and fragments thereof. In one aspect, the present disclosure provides a recombinant DNA construct comprising a promoter that is functional in a tobacco cell and operably linked to a polynucleotide having at least 60%, at least 70%, at least 75%, at least 80%, at least 85%, at least 90%, at least 95%, at least 96%, at least 97%, at least 98%, at least 99%, or 100% identical to a polynucleotide selected from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83-160, 186, 188, 190, 192, 194, 196, 198, 200, 202, 204, 205, 207, 209, 211, 213, 215, 217, 219, 221, 223, 225-228, 230, 232, 234, 236, 238, 240, 242, 244, 246, 248, 250, 252, 254, and fragments thereof.

In one aspect, the present disclosure provides a recombinant DNA construct comprising a promoter that is functional in a tobacco cell and operably linked to a polynucleotide that encodes an RNA molecule capable of binding to an RNA encoding a polypeptide having an amino acid sequence at least 60%, at least 70%, at least 75%, at least 80%, at least 85%, at least 90%, at least 95%, at least 96%, at least 97%, at least 98%, at least 99%, or 100% identical to an amino acid sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 70, 72, 74, 76, 78, 161-185, 187, 189, 191, 197, 199, 224, 229, 231, 233, 235, 237, 239, 241, 243, 245, 247, 249, 251, 253, 255, and fragments thereof, and where the RNA molecule suppresses the expression of the polypeptide. In one aspect, the present disclosure provides a recombinant DNA construct comprising a promoter that is functional in a tobacco cell and operably linked to a polynucleotide having at least 60%, at least 70%, at least 75%, at least 80%, at least 85%, at least 90%, at least 95%, at least 96%, at least 97%, at least 98%, at least 99%, or 100% identical to a polynucleotide selected from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83-160, 186, 188, 190, 192, 194, 196, 198, 200, 202, 204, 205, 207, 209, 211, 213, 215, 217, 219, 221, 223, 225-228, 230, 232, 234, 236, 238, 240, 242, 244, 246, 248, 250, 252, 254, and fragments thereof, and where the RNA molecule suppresses the expression of the polynucleotide.

In one aspect, this disclosure provides a recombinant DNA construct comprising a heterologous axillary meristem-specific promoter operably linked to a polynucleotide that encodes a non-coding RNA molecule, where the non-coding RNA molecule is capable of binding to an RNA encoding a polypeptide having at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 70, 72, 74, 76, 78, 161-185, 187, 189, 191, 197, 199, 224, 229, 231, 233, 245, 247, 249, 251, 253, and 255, and where the non-coding RNA molecule suppresses the expression of the polypeptide.

In one aspect, this disclosure provides a method for controlling topping-induced suckering in a plant comprising transforming the plant with a recombinant DNA construct, where the recombinant DNA construct comprises a heterologous promoter that is functional in an L1 layer, an L2 layer, an L3 region, a rib zone, a central zone, a peripheral zone, or a combination thereof, and where the promoter is operably linked to a polynucleotide that encodes a non-coding RNA molecule, where the non-coding RNA molecule is capable of binding to an RNA encoding a polypeptide having at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 70, 72, 74, 76, 78, 161-185, 187, 189, 191, 197, 199, 224, 229, 231, 233, 245, 247, 249, 251, 253, and 255, and where the non-coding RNA molecule suppresses the expression of the polypeptide.

MicroRNAs (miRNAs) are non-protein coding RNAs, generally of between about 19 to about 25 nucleotides (commonly about 20-24 nucleotides in plants), that guide cleavage in trans of target transcripts, negatively regulating the expression of genes involved in various regulation and development pathways (Bartel (2004) Cell, 116:281-297). In some cases, miRNAs serve to guide in-phase processing of siRNA primary transcripts (see Allen et al. (2005) Cell, 121:207-221).

Many microRNA genes (MIR genes) have been identified and made publicly available in a database ("miRBase", available on line at microrna.sanger.ac.uk/sequences; also see Griffiths-Jones et al. (2003) Nucleic Acids Res., 31:439-441). MIR genes have been reported to occur in intergenic regions, both isolated and in clusters in the genome, but can also be located entirely or partially within introns of other genes (both protein-coding and non-protein-coding). For a recent review of miRNA biogenesis, see Kim (2005) Nature Rev. Mol. Cell. Biol., 6:376-385. Transcription of MIR genes can be, at least in some cases, under promotional control of a MIR gene's own promoter. The primary transcript, termed a "pri-miRNA", can be quite large (several kilobases) and can be polycistronic, containing one or more pre-miRNAs (fold-back structures containing a stem-loop arrangement that is processed to the mature miRNA) as well as the usual 5' "cap" and polyadenylated tail of an mRNA. See, for example, FIG. 1 in Kim (2005) Nature Rev. Mol. Cell. Biol., 6:376-385.

Maturation of a mature miRNA from its corresponding precursors (pri-miRNAs and pre-miRNAs) differs significantly between animals and plants. For example, in plant cells, microRNA precursor molecules are believed to be largely processed to the mature miRNA entirely in the nucleus, whereas in animal cells, the pri-miRNA transcript is processed in the nucleus by the animal-specific enzyme Drosha, followed by export of the pre-miRNA to the cytoplasm where it is further processed to the mature miRNA. Mature miRNAs in plants are typically 21 nucleotides in length. For a recent review of miRNA biogenesis in both plants and animals, see Kim (2005) Nature Rev. Mol. Cell. Biol., 6:376-385. Additional reviews on miRNA biogenesis and function are found, for example, in Bartel (2004) Cell, 116:281-297; Murchison and Hannon (2004) Curr. Opin. Cell Biol., 16:223-229; and Dugas and Bartel (2004) Curr. Opin. Plant Biol., 7:512-520.

Transgenic expression of miRNAs (whether a naturally occurring sequence or an artificial sequence) can be employed to regulate expression of the miRNA's target gene or genes. Inclusion of a miRNA recognition site in a transgenically expressed transcript is also useful in regulating expression of the transcript; see, for example, Parizotto et al. (2004) Genes Dev., 18:2237-2242. Recognition sites of miRNAs have been validated in all regions of an mRNA, including the 5' untranslated region, coding region, and 3' untranslated region, indicating that the position of the miRNA target site relative to the coding sequence may not necessarily affect suppression (see, e.g., Jones-Rhoades and Bartel (2004). Mol. Cell, 14:787-799, Rhoades et al. (2002) Cell, 110:513-520, Allen et al. (2004) Nat. Genet., 36:1282-1290, Sunkar and Zhu (2004) Plant Cell, 16:2001-2019). Because miRNAs are important regulatory elements in eukaryotes, transgenic suppression of miRNAs is useful for manipulating biological pathways and responses. Finally, promoters of MIR genes can have very specific expression patterns (e.g., cell-specific, tissue-specific, temporally specific, or inducible), and thus are useful in recombinant constructs to induce such specific transcription of a DNA sequence to which they are operably linked. Various utilities of miRNAs, their precursors, their recognition sites, and their promoters are described in detail in U.S. Patent Application Publication 2006/0200878 A1, incorporated by reference herein. Non-limiting examples of these utilities include: (1) the expression of a native miRNA or miRNA precursor sequence to suppress a target gene; (2) the expression of an artificial miRNA or miRNA precursor sequence to suppress a target gene; (3) expression of a transgene with a miRNA recognition site, where the transgene is suppressed when the mature miRNA is expressed; (4) expression of a transgene driven by a miRNA promoter.

Designing an artificial miRNA sequence can be as simple as substituting sequence that is complementary to the intended target for nucleotides in the miRNA stem region of the miRNA precursor, as demonstrated by Zeng et al. (2002) Mol. Cell, 9:1327-1333. One non-limiting example of a general method for determining nucleotide changes in the native miRNA sequence to produce the engineered miRNA precursor includes the following steps: (a) Selecting a unique target sequence of at least 18 nucleotides specific to the target gene, e.g., by using sequence alignment tools such as BLAST (see, for example, Altschul et al. (1990) J. Mol. Biol., 215:403-410; Altschul et al. (1997) Nucleic Acids Res., 25:3389-3402), for example, of both tobacco cDNA and genomic DNA databases, to identify target transcript orthologues and any potential matches to unrelated genes, thereby avoiding unintentional silencing of non-target sequences; (b) Analyzing the target gene for undesirable sequences (e.g., matches to sequences from non-target species), and score each potential 19-mer segment for GC content, Reynolds score (see Reynolds et al. (2004) Nature Biotechnol., 22:326-330), and functional asymmetry characterized by a negative difference in free energy (".DELTA.DELTA.G" or "AAG") (see Khvorova et al. (2003) Cell, 115:209-216). Preferably 19-mers are selected that have all or most of the following characteristics: (1) a Reynolds score>4, (2) a GC content between about 40% to about 60%, (3) a negative AAG, (4) a terminal adenosine, (5) lack of a consecutive run of 4 or more of the same nucleotide; (6) a location near the 3' terminus of the target gene; (7) minimal differences from the miRNA precursor transcript. Positions at every third nucleotide in an siRNA have been reported to be especially important in influencing RNAi efficacy and an algorithm, "siExplorer" is publicly available at rna.chem.t.u-tokyo.ac.jp/siexplorer.htm (see Katoh and Suzuki (2007) Nucleic Acids Res., 10.1093/nar/gkl1120); (c) Determining the reverse complement of the selected 19-mers to use in making a modified mature miRNA. The additional nucleotide at position 20 is preferably matched to the selected target sequence, and the nucleotide at position 21 is preferably chosen to either be unpaired to prevent spreading of silencing on the target transcript or paired to the target sequence to promote spreading of silencing on the target transcript; and (d) transforming the artificial miRNA into a plant.

In one aspect, an artificial miRNA provided herein is complementary to a polynucleotide having at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence identity to a polynucleotide selected from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 69, 71, 73, 75, 77, 83-160, 186, 188, 190, 196, 198, 223, 225-228, 230, 232, 234, 236, 238, 240, 242, 244, 246, 248, 250, 252, 254, and fragments thereof. In another aspect, an artificial miRNA provided herein is complementary to a polynucleotide encoding a polypeptide having at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 70, 72, 74, 76, 78, 161-185, 189, 191, 197, 199, 224, 229, 231, 233, 235, 237, 239, 241, 243, 245, 247, 249, 251, 253, 255. In yet another aspect, an artificial miRNA provided herein is complementary to a polynucleotide encoding a polypeptide having at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence similarity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 70, 72, 74, 76, 78, 161-185, 189, 191, 197, 199, 224, 229, 231, 233, 235, 237, 239, 241, 243, 245, 247, 249, 251, 253, 255.

In one aspect, an artificial miRNA provided herein reduces or eliminates RNA transcription or protein translation of a target gene.

In one aspect, a miRNA or an artificial miRNA provided herein is under the control of a tissue specific promoter. In another aspect, a miRNA or an artificial miRNA provided herein is under the control of a promoter selected from the group consisting of SEQ ID NOs: 113-118, 148-160, 204, and a fragment thereof. In one aspect, a modified plant provided herein comprises an artificial miRNA under the control of a heterologous promoter selected from the group consisting of SEQ ID NOs: 113-118, 148-160, 204, and a fragment thereof.

Plant microRNAs regulate their target genes by recognizing and binding to a near-perfectly complementary sequence (miRNA recognition site) in the target transcript, followed by cleavage of the transcript by RNase III enzymes such as Argonaute1. In plants, certain mismatches between a given miRNA recognition site and the corresponding mature miRNA are not tolerated, particularly mismatched nucleotides at positions 10 and 11 of the mature miRNA. Positions within the mature miRNA are given in the 5' to 3' direction. Perfect complementarity between a given miRNA recognition site and the corresponding mature miRNA is usually required at positions 10 and 11 of the mature miRNA. See, for example, Franco-Zorrilla et al. (2007) Nature Genetics, 39:1033-1037; and Axtell et al. (2006) Cell, 127:565-577.

This characteristic of plant miRNAs is exploited to arrive at rules for predicting a "microRNA decoy sequence", i.e., a sequence that can be recognized and bound by an endogenous mature miRNA resulting in base-pairing between the miRNA decoy sequence and the endogenous mature miRNA, thereby forming a cleavage-resistant RNA duplex that is not cleaved because of the presence of mismatches between the miRNA decoy sequence and the mature miRNA. Mismatches include canonical mismatches (e.g., G-A, C-U, C-A) as well as G:U wobble pairs and indels (nucleotide insertions or deletions). In general, these rules define (1) mismatches that are required, and (2) mismatches that are permitted but not required.

Required mismatches include: (a) at least 1 mismatch between the miRNA decoy sequence and the endogenous mature miRNA at positions 9, 10, or 11 of the endogenous mature miRNA, or alternatively, (b) 1, 2, 3, 4, or 5 insertions (i.e., extra nucleotides) at a position in the miRNA decoy sequence corresponding to positions 9, 10, or 11 of the endogenous mature miRNA.

Mismatches that are permitted, but not required, include: (a) 0,1, or 2 mismatches between the miRNA decoy sequence and the endogenous mature miRNA at positions 1, 2, 3, 4, 5, 6, 7, 8, and 9 of the endogenous mature miRNA, and (b) 0, 1, 2, or 3 mismatches between the miRNA decoy sequence and the endogenous mature miRNA at positions 12 through the last position of the endogenous mature miRNA (i.e., at position 21 of a 21-nucleotide mature miRNA), where each of the mismatches at positions 12 through the last position of the endogenous mature miRNA is adjacent to at least one complementary base-pair (i.e., so that there is not more than 2 contiguous mismatches at positions 12 through the last position of the endogenous mature miRNA).

A miRNA decoy sequence can be of any length as long as it is recognized and bound by an endogenous mature miRNA to form a cleavage-resistant RNA duplex. In one aspect, a miRNA decoy sequence includes between about 18 to about 36 nucleotides. In another aspect, a microRNA decoy provided herein is a small RNA molecule of at least 15, at least 16, at least 17, at least 18, at least 19, at least 20, at least 21, at least 22, at least 23, at least 24, at least 25, at least 26, at least 27, at least 28, at least 29, at least 30, or more than 30 nucleotides that is capable of binding to a mature miRNA. See, for example, WO 2008/133643, which is herein incorporated by reference in its entirety.

In one aspect, an endogenous miRNA is regulated by a miRNA decoy provided herein. A microRNA decoy provided herein is capable of preventing a complementary mature miRNA from binding its native target gene, thereby increasing expression of the target gene.

In another aspect, a recombinant DNA construct provided herein comprises at least 1, at least 2, at least 3, at least 4, at least 5, at least 6, at least 7, at least 8, at least 9, at least 10, or more than 10 miRNA decoys. In one aspect, a miRNA decoy provided herein is under the control of a regulatory sequence selected from the group consisting of SEQ ID NOs: 113-118, 148-160, 204, and a fragment thereof.

In another aspect, an endogenous miRNA target is edited with a site-specific nuclease provided herein to mutate at least one miRNA binding site, thereby rendering the endogenous miRNA target resistant to miRNA-mediated degradation. As used herein, a "miRNA target" refers to a contiguous stretch of at least 18, at least 19, at least 20, at least 21, at least 22, at least 23, at least 24, at least 25, at least 26, at least 27, at least 28, at least 29, at least 30, or more than 30 nucleotides having at least 75%, at least 80%, at least 85%, at least 88%, at least 90%, at least 91%, at least 92%, at least 93%, at least 94%, at least 95%, at least 96%, at least 97%, at least 98%, at least 99% or 100% identity to a mature miRNA. In one aspect, a miRNA target is capable of being hybridized by a mature miRNA, and then cleaved by a mature miRNA/Argonaute RNA-induced silencing complex, under typical cellular conditions.

Also provided herein is cured tobacco material made from tobacco plants or plant components provided herein. "Curing" is the aging process that reduces moisture and brings about the destruction of chlorophyll giving tobacco leaves a golden color and by which starch is converted to sugar. Cured tobacco therefore has a higher reducing sugar content and a lower starch content compared to harvested green leaf. In one aspect, tobacco plants or plant components provided herein can be cured using conventional means, e.g., flue-cured, barn-cured, fire-cured, air-cured or sun-cured. See, for example, Tso (1999, Chapter 1 in Tobacco, Production, Chemistry and Technology, Davis & Nielsen, eds., Blackwell Publishing, Oxford) for a description of different types of curing methods. Cured tobacco is usually aged in a wooden drum (e.g., a hogshead) or cardboard cartons in compressed conditions for several years (e.g., two to five years), at a moisture content ranging from 10% to about 25%. See, U.S. Pat. Nos. 4,516,590 and 5,372,149. Cured and aged tobacco then can be further processed. Further processing includes conditioning the tobacco under vacuum with or without the introduction of steam at various temperatures, pasteurization, and fermentation. Fermentation typically is characterized by high initial moisture content, heat generation, and a 10 to 20% loss of dry weight. See, for example, U.S. Pat. Nos. 4,528,993, 4,660,577, 4,848,373, 5,372,149; U.S. Publication No. 2005/0178398; and Tso (1999, Chapter 1 in Tobacco, Production, Chemistry and Technology, Davis & Nielsen, eds., Blackwell Publishing, Oxford). Cured, aged, and fermented tobacco can be further processed (e.g., cut, shredded, expanded, or blended). See, for example, U.S. Pat. Nos. 4,528,993; 4,660,577; and 4,987,907. In one aspect, the cured tobacco material of the present disclosure is flue-cured, sun-cured, air-cured, or fire-cured.

Tobacco material obtained from modified tobacco lines, varieties or hybrids of the present disclosure can be used to make tobacco products. As used herein, "tobacco product" is defined as any product made or derived from tobacco that is intended for human use or consumption. In an aspect, a tobacco product provided herein comprises cured components from a modified tobacco plant provided herein. In another aspect, a tobacco product provided herein comprises cured tobacco leaves from a modified tobacco plant provided herein.

Tobacco products provided herein include, without limitation, cigarette products (e.g., cigarettes, bidi cigarettes, kreteks), cigar products (e.g., cigars, cigar wrapping tobacco, cigarillos), pipe tobacco products, products derived from tobacco, tobacco-derived nicotine products, smokeless tobacco products (e.g., moist snuff, dry snuff, chewing tobacco, moist smokeless tobacco, fine cut chewing tobacco, long cut chewing tobacco, pouched chewing tobacco), films, chewables (e.g., gum), lozenges, dissolving strips, tabs, tablets, shaped parts, gels, consumable units, insoluble matrices, hollow shapes, reconstituted tobacco, expanded tobacco, and the like. See, for example, U.S. Patent Publication No. US 2006/0191548.

As used herein, "cigarette" refers a tobacco product having a "rod" and "filler". The cigarette "rod" includes the cigarette paper, filter, plug wrap (used to contain filtration materials), tipping paper that holds the cigarette paper (including the filler) to the filter, and all glues that hold these components together. The "filler" includes (1) all tobaccos, including but not limited to reconstituted and expanded tobacco, (2) non-tobacco substitutes (including but not limited to herbs, non-tobacco plant materials and other spices that may accompany tobaccos rolled within the cigarette paper), (3) casings, (4) flavorings, and (5) all other additives (that are mixed into tobaccos and substitutes and rolled into the cigarette).

In one aspect, this disclosure provides nicotine derived from and a method of producing nicotine from a modified tobacco plant provided herein for use in a product.

In one aspect, a method provided herein comprises preparing a tobacco product using a cured tobacco leaf from a modified tobacco plant provided herein.

As used herein, "reconstituted tobacco" refers to a part of tobacco filler made from tobacco dust and other tobacco scrap material, processed into sheet form and cut into strips to resemble tobacco. In addition to the cost savings, reconstituted tobacco is very important for its contribution to cigarette taste from processing flavor development using reactions between ammonia and sugars.

As used herein, "expanded tobacco" refers to a part of tobacco filler which is processed through expansion of suitable gases so that the tobacco is "puffed" resulting in reduced density and greater filling capacity. It reduces the weight of tobacco used in cigarettes.

Tobacco products derived from plants of the present disclosure also include cigarettes and other smoking articles, particularly those smoking articles including filter elements, where the rod of smokeable material includes cured tobacco within a tobacco blend. In an aspect, a tobacco product of the present disclosure is selected from the group consisting of a cigarillo, a non-ventilated recess filter cigarette, a vented recess filter cigarette, a bidi cigarette, a cigar, snuff, pipe tobacco, cigar tobacco, cigarette tobacco, chewing tobacco, leaf tobacco, hookah tobacco, shredded tobacco, and cut tobacco. In another aspect, a tobacco product of the present disclosure is a smokeless tobacco product. Smokeless tobacco products are not combusted and include, but not limited to, chewing tobacco, moist smokeless tobacco, snus, and dry snuff. Chewing tobacco is coarsely divided tobacco leaf that is typically packaged in a large pouch-like package and used in a plug or twist. Moist smokeless tobacco is a moist, more finely divided tobacco that is provided in loose form or in pouch form and is typically packaged in round cans and used as a pinch or in a pouch placed between an adult tobacco consumer's cheek and gum. Snus is a heat treated smokeless tobacco. Dry snuff is finely ground tobacco that is placed in the mouth or used nasally. In a further aspect, a tobacco product of the present disclosure is selected from the group consisting of loose leaf chewing tobacco, plug chewing tobacco, moist snuff, and nasal snuff. In yet another aspect, a tobacco product of the present disclosure is selected from the group consisting of an electronically heated cigarette, an e-cigarette, an electronic vaporing device.

The present disclosure further provides a method manufacturing a tobacco product comprising tobacco material from tobacco plants provided herein. In one aspect, methods provided herein comprise conditioning aged tobacco material made from tobacco plants provided herein to increase its moisture content from between about 12.5% and about 13.5% to about 21%, blending the conditioned tobacco material to produce a desirable blend. In one aspect, the method of manufacturing a tobacco product provided herein further comprises casing or flavoring the blend. Generally, during the casing process, casing or sauce materials are added to blends to enhance their quality by balancing the chemical composition and to develop certain desired flavor characteristics. Further details for the casing process can be found in *Tobacco Production, Chemistry and Technology*, Edited by L. Davis and M. Nielsen, Blackwell Science, 1999.

Tobacco material provided herein can be also processed using methods including, but not limited to, heat treatment (e.g., cooking, toasting), flavoring, enzyme treatment, expansion and/or curing. Both fermented and non-fermented tobaccos can be processed using these techniques. Examples of suitable processed tobaccos include dark air-cured, dark fire cured, burley, flue cured, and cigar filler or wrapper, as well as the products from the whole leaf stemming operation. In one aspect, tobacco fibers include up to 70% dark tobacco on a fresh weight basis. For example, tobacco can be conditioned by heating, sweating and/or pasteurizing steps as described in U.S. Publication Nos. 2004/0118422 or 2005/0178398.

Tobacco material provided herein can be subject to fermentation. Fermenting typically is characterized by high initial moisture content, heat generation, and a 10 to 20% loss of dry weight. See, e.g., U.S. Pat. Nos. 4,528,993; 4,660,577; 4,848,373; and 5,372,149. In addition to modifying the aroma of the leaf, fermentation can change either or both the color and texture of a leaf. Also during the fermentation process, evolution gases can be produced, oxygen can be taken up, the pH can change, and the amount of water retained can change. See, for example, U.S. Publication No. 2005/0178398 and Tso (1999, Chapter 1 in Tobacco, Production, Chemistry and Technology, Davis & Nielsen, eds., Blackwell Publishing, Oxford). Cured, or cured and fermented tobacco can be further processed (e.g., cut, expanded, blended, milled or comminuted) prior to incorporation into the oral product. The tobacco, in some cases, is long cut fermented cured moist tobacco having an oven volatiles content of between 48 and 50 weight percent prior to mixing with a copolymer and, optionally, flavorants and other additives.

In one aspect, tobacco material provided herein can be processed to a desired size. In certain aspects, tobacco fibers can be processed to have an average fiber size of less than 200 micrometers. In one aspect, tobacco fibers are between 75 and 125 micrometers. In another aspect, tobacco fibers are processed to have a size of 75 micrometers or less. In one aspect, tobacco fibers include long cut tobacco, which can be cut or shredded into widths of about 10 cuts/inch up to about 110 cuts/inch and lengths of about 0.1 inches up to about 1 inch. Double cut tobacco fibers can have a range of particle sizes such that about 70% of the double cut tobacco fibers falls between the mesh sizes of −20 mesh and 80 mesh.

Tobacco material provided herein can be processed to have a total oven volatiles content of about 10% by weight or greater; about 20% by weight or greater; about 40% by weight or greater; about 15% by weight to about 25% by weight; about 20% by weight to about 30% by weight; about 30% by weight to about 50% by weight; about 45% by weight to about 65% by weight; or about 50% by weight to about 60% by weight. Those of skill in the art will appreciate that "moist" tobacco typically refers to tobacco that has an oven volatiles content of between about 40% by weight and about 60% by weight (e.g., about 45% by weight to about 55% by weight, or about 50% by weight). As used herein, "oven volatiles" are determined by calculating the percentage of weight loss for a sample after drying the sample in a pre-warmed forced draft oven at 110° C. for 3.25 hours. An oral product can have a different overall oven volatiles content than the oven volatiles content of the tobacco fibers used to make the oral product. The processing steps described herein can reduce or increase the oven volatiles content.

In one aspect, tobacco plants, seeds, plant components, plant cells, and plant genomes provided herein are from a tobacco type selected from the group consisting of flue-cured tobacco, sun-cured tobacco, air-cured tobacco, dark air-cured tobacco, and dark fire-cured tobacco. In another aspect, tobacco plants, seeds, plant components, plant cells, and plant genomes provided herein are from a tobacco type selected from the group consisting of Burley tobacco, Maryland tobacco, bright tobacco, Virginia tobacco, Oriental tobacco, Turkish tobacco, and Galpão tobacco. In one aspect, a tobacco plants or seed provided herein is a hybrid plants or seed. As used herein, a "hybrid" is created by crossing two plants from different varieties or species, such that the progeny comprises genetic material from each parent. Skilled artisans recognize that higher order hybrids can be generated as well. For example, a first hybrid can be made by crossing Variety C with Variety D to create a C×D hybrid, and a second hybrid can be made by crossing Variety E with Variety F to create an E×F hybrid. The first and second hybrids can be further crossed to create the higher order hybrid (C×D)×(E×F) comprising genetic information from all four parent varieties.

Flue-cured tobaccos (also called Virginia of bright tobaccos) amount to approximately 40% of world tobacco production. Flue-cured tobaccos are often also referred to as "bright tobacco" because of the golden-yellow to deep-orange color it reaches during curing. Flue-cured tobaccos have a light, bright aroma and taste. Flue-cured tobaccos are generally high in sugar and low in oils. Major flue-cured tobacco growing countries are Argentina, Brazil, China, India, Tanzania and the U.S. In one aspect, modified tobacco plants or seeds provided herein are in a flue-cured tobacco background selected from the group consisting of CC 13, CC 27, CC 33, CC35, CC 37, CC 65, CC 67, CC 700, GF 318, GL 338, GL 368, GL 939, K 346, K 399, K326, NC 102, NC 196, NC 291, NC 297, NC 299, NC 471, NC 55, NC 606, NC 71, NC 72, NC 92, PVH 1118, PVH 1452, PVH 2110, SPEIGHT 168, SPEIGHT 220, SPEIGHT 225, SPEIGHT 227, SPEIGHT 236, and any variety essentially derived from any one of the foregoing varieties. In another aspect, modified tobacco plants or seeds provided herein are in a flue-cured tobacco background selected from the group consisting of Coker 48, Coker 176, Coker 371-Gold, Coker 319, Coker 347, GL 939, K 149, K326, K 340, K 346, K 358, K 394, K 399, K 730, NC 27NF, NC 37NF, NC 55, NC 60, NC 71, NC 72, NC 82, NC 95, NC 297, NC 606, NC 729, NC 2326, McNair 373, McNair 944, Ox 207, Ox 414 NF, Reams 126, Reams 713, Reams 744, RG 8, RG 11, RG 13, RG 17, RG 22, RG 81, RG H4, RG H51, Speight H-20, Speight G-28, Speight G-58, Speight G-70, Speight G-108, Speight G-111, Speight G-117, Speight 168, Speight 179, Speight NF-3, Va 116, Va 182, and any variety essentially derived from any one of the foregoing varieties. See WO 2004/041006 A1. In further aspects, modified tobacco plants, seeds, hybrids, varieties, or lines provided herein are in any flue cured background selected from the group consisting of K326, K346, and NC196.

Air-cured tobaccos include Burley, Md., and dark tobaccos. The common factor is that curing is primarily without artificial sources of heat and humidity. Burley tobaccos are light to dark brown in color, high in oil, and low in sugar. Burley tobaccos are air-cured in barns. Major Burley growing countries are Argentina, Brazil, Italy, Malawi, and the U.S. Maryland tobaccos are extremely fluffy, have good burning properties, low nicotine and a neutral aroma. Major Maryland growing countries include the U.S. and Italy. In one aspect, modified tobacco plants or seeds provided herein are in a Burley tobacco background selected from the group consisting of Clay 402, Clay 403, Clay 502, Ky 14, Ky 907, Ky 910, Ky 8959, NC 2, NC 3, NC 4, NC 5, NC 2000, TN 86, TN 90, TN 97, R 610, R 630, R 711, R 712, NCBH 129, HB4488PLC, PD 7319LC, Bu 21×Ky 10, HB04P, Ky 14×L 8, Kt 200, Newton 98, Pedigo 561, Pf561 and Va 509. In further aspects, modified tobacco plants, seeds, hybrids, varieties, or lines provided herein are in any Burley background selected from the group consisting of TN 90, KT 209, KT 206, KT212, and HB 4488. In another aspect, modified tobacco plants or seeds provided herein are in a Maryland tobacco background selected from the group consisting of Md 10, Md 40, Md 201, Md 609, Md 872 and Md 341.

Dark air-cured tobaccos are distinguished from other types primarily by its curing process which gives dark air-cured tobacco its medium- to dark-brown color and distinct aroma. Dark air-cured tobaccos are mainly used in the production of chewing tobacco and snuff. In one aspect, modified tobacco plants or seeds provided herein are in a dark air-cured tobacco background selected from the group consisting of Sumatra, Jatim, Dominican Cubano, Besuki, One sucker, Green River, Va. sun-cured, and Paraguan Passado.

Dark fire-cured tobaccos are generally cured with low-burning wood fires on the floors of closed curing barns. Dark fire-cured tobaccos are used for making pipe blends, cigarettes, chewing tobacco, snuff and strong-tasting cigars. Major growing regions for dark fire-cured tobaccos are Tennessee, Kentucky, and Virginia, USA. In one aspect, modified tobacco plants or seeds provided herein are in a dark fire-cured tobacco background selected from the group consisting of Narrow Leaf Madole, Improved Madole, Tom Rosson Madole, Newton's VH Madole, Little Crittenden, Green Wood, Little Wood, Small Stalk Black Mammoth, DT 508, DT 518, DT 592, KY 171, DF 911, DF 485, TN D94, TN D950, VA 309, and VA 359.

Oriental tobaccos are also referred to as Greek, aroma and Turkish tobaccos due to the fact that they are typically grown in eastern Mediterranean regions such as Turkey, Greece, Bulgaria, Macedonia, Syria, Lebanon, Italy, and Romania. The small plant and leaf size, characteristic of today's Oriental varieties, as well as its unique aroma properties are a result of the plant's adaptation to the poor soil and stressful climatic conditions in which it develop over many past centuries. In one aspect, modified tobacco plants or seeds provided herein are in an Oriental tobacco background selected from the group consisting of Izmir, Katerini, Samsun, Basma and Krumovgrad, Trabzon, Thesalian, Tasova, Sinop, Izmit, Hendek, Edirne, Semdinli, Adiyanman, Yayladag, Iskenderun, Duzce, Macedonian, Mavra, Prilep, Bafra, Bursa, Bucak, Bitlis, Balikesir, and any variety essentially derived from any one of the foregoing varieties.

In one aspect, modified tobacco plants, seeds, hybrids, varieties, or lines provided herein are essentially derived from or in the genetic background of BU 64, CC 101, CC 200, CC 13, CC 27, CC 33, CC 35, CC 37, CC 65, CC 67, CC 301, CC 400, CC 500, CC 600, CC 700, CC 800, CC 900, CC 1063, Coker 176, Coker 319, Coker 371 Gold, Coker 48, CU 263, DF911, Galpão, GL 26H, GL 338, GL 350, GL 395, GL 600, GL 737, GL 939, GL 973, GF 157, GF 318, RJR 901, HB 04P, K 149, K 326, K 346, K 358, K394, K 399, K 730, NC 196, NC 37NF, NC 471, NC 55, NC 92, NC2326, NC 95, NC 925, PVH 1118, PVH 1452, PVH 2110, PVH 2254, PVH 2275, VA 116, VA 119, KDH 959, KT 200, KT204LC, KY 10, KY 14, KY 160, KY 17, KY 171, KY 907, KY 907LC, KTY14×L8 LC, Little Crittenden, McNair 373, McNair 944, male sterile KY 14×L8, Narrow Leaf Madole, MS KY171, Narrow Leaf Madole (phph), MS Narrow Leaf Madole, MS TND950, PD 7302LC, PD 7305LC, PD 7309LC, PD 7312LC, PD 7318LC, PD 7319LC, MSTKS 2002, TKF 2002, TKF 6400, TKF 4028, TKF 4024, KT206LC, KT209LC, KT210LC, KT212LC, NC 100, NC 102, NC 2000, NC 291, NC 297, NC 299, NC 3, NC 4, NC 5, NC 6, NC7, NC 606, NC 71, NC 72, NC 810, NC BH 129, NC 2002, Neal Smith Madole, OXFORD 207, 'Perique', PVH03, PVH09, PVH19, PVH50, PVH51, R 610, R 630, R 7-11, R 7-12, RG 17, RG 81, RG H51, RGH 4, RGH 51, RS 1410, Speight 168, Speight 172, Speight 179, Speight 210, Speight 220, Speight 225, Speight 227, Speight 234, Speight G-28, Speight G-70, Speight H-6, Speight H20, Speight NF3, TI 1406, TI 1269, TN 86, TN86LC, TN 90, TN90LC, TN 97, TN97LC, TN D94, TN D950, a TR (Tom Rosson) Madole, Va. 309, VA 359, or any commercial tobacco variety according to standard tobacco breeding techniques known in the art.

All foregoing mentioned specific varieties of dark air-cured, Burley, Md., dark fire-cured, or Oriental type are only listed for exemplary purposes. Any additional dark air-cured, Burley, Md., dark fire-cured, Oriental varieties are also contemplated in the present application.

Also provided herein are populations of tobacco plants described herein. In one aspect, a population of tobacco plants provided herein has a planting density of between about 5,000 and about 8000, between about 5,000 and about 7,600, between about 5,000 and about 7,200, between about 5,000 and about 6,800, between about 5,000 and about 6,400, between about 5,000 and about 6,000, between about 5,000 and about 5,600, between about 5,000 and about 5,200, between about 5,200 and about 8,000, between about 5,600 and about 8,000, between about 6,000 and about 8,000, between about 6,400 and about 8,000, between about 6,800 and about 8,000, between about 7,200 and about 8,000, or between about 7,600 and about 8,000 plants per acre. In another aspect, a population of tobacco plants provided herein is in a soil type with low to medium fertility.

Also provided herein are containers of seeds from tobacco plants described herein. A container of tobacco seeds of the present disclosure may contain any number, weight, or volume of seeds. For example, a container can contain at least, or greater than, about 100, at least, or greater than, about 200, at least, or greater than, about 300, at least, or greater than, about 400, at least, or greater than, about 500, at least, or greater than, about 600, at least, or greater than, about 700, at least, or greater than, about 800, at least, or greater than, about 900, at least, or greater than, about 1000, at least, or greater than, about 1500, at least, or greater than, about 2000, at least, or greater than, about 2500, at least, or greater than, about 3000, at least, or greater than, about 3500, at least, or greater than, or about 4000 or more seeds. Alternatively, the container can contain at least, or greater than, about 1 ounce, at least, or greater than, about 5 ounces, at least, or greater than, about 10 ounces, at least, or greater than, about 1 pound, at least, or greater than, about 2 pounds, at least, or greater than, about 3 pounds, at least, or greater than, about 4 pounds, at least, or greater than, about 5 pounds or more seeds. Containers of tobacco seeds may be any container available in the art. By way of non-limiting example, a container may be a box, a bag, a packet, a pouch, a tape roll, a tube, or a bottle.

The present disclosure also provides methods for breeding tobacco lines, cultivars, or varieties comprising reduced or eliminated suckering. Breeding can be carried out via any known procedures. DNA fingerprinting, SNP mapping, haplotype mapping or similar technologies may be used in a marker-assisted selection (MAS) breeding program to transfer or breed a desirable trait or allele into a tobacco plant. For example, a breeder can create segregating populations in an $F_2$ or backcross generation using $F_1$ hybrid plants provided herein or further crossing the $F_1$ hybrid plants with other donor plants with an agronomically desirable genotype. Plants in the $F_2$ or backcross generations can be screened for a desired agronomic trait or a desirable chemical profile using one of the techniques known in the art or listed herein. Depending on the expected inheritance pattern or the MAS technology used, self-pollination of selected plants before each cycle of backcrossing to aid identification of the desired individual plants can be performed. Backcrossing or other breeding procedure can be repeated until the desired phenotype of the recurrent parent is recovered. In one aspect, a recurrent parent in the present disclosure can be a flue-cured variety, a Burley variety, a dark air-cured variety, a dark fire-cured variety, or an Oriental variety. In another aspect, a recurrent parent can be a modified tobacco plant, line, or variety. Other breeding techniques can be found, for example, in Wernsman, E. A., and Rufty, R. C. 1987. Chapter Seventeen. Tobacco. Pages 669-698 In: Cultivar Development. Crop Species. W. H. Fehr (ed.), MacMillan Publishing Co., Inc., New York, N.Y., incorporated herein by reference in their entirety.

Results of a plant breeding program using modified tobacco plants described herein includes useful lines, cultivars, varieties, progeny, inbreds, and hybrids of the present disclosure. As used herein, the term "variety" refers to a population of plants that share constant characteristics which separate them from other plants of the same species. A variety is often, although not always, sold commercially. While possessing one or more distinctive traits, a variety is further characterized by a very small overall variation between individuals within that variety. A "pure line" variety may be created by several generations of self-pollination and selection, or vegetative propagation from a single parent using tissue or cell culture techniques. A variety can be essentially derived from another line or variety. As defined by the International Convention for the Protection of New Varieties of Plants (Dec. 2, 1961, as revised at Geneva on Nov. 10, 1972; on Oct. 23, 1978; and on Mar. 19, 1991), a variety is "essentially derived" from an initial variety if: a) it is predominantly derived from the initial variety, or from a variety that is predominantly derived from the initial variety, while retaining the expression of the essential characteristics that result from the genotype or combination of genotypes of the initial variety; b) it is clearly distinguishable from the initial variety; and c) except for the differences which result from the act of derivation, it conforms to the initial variety in the expression of the essential characteristics that result from the genotype or combination of genotypes of the initial variety. Essentially derived varieties can be obtained, for example, by the selection of a natural or induced mutant, a somaclonal variant, a variant individual from plants of the initial variety, backcrossing, or transformation. A first tobacco variety and a second tobacco variety from which the first variety is essentially derived, are considered as having essentially identical genetic background. A "line" as distinguished from a variety most often denotes a group of plants used non-commercially, for example in plant research. A line typically displays little overall variation between individuals for one or more traits of interest, although there may be some variation between individuals for other traits.

In one aspect, the present disclosure provides a method of producing a tobacco plant comprising crossing at least one tobacco plant of a first tobacco variety with at least one tobacco plant of a second tobacco variety, where the at least one tobacco plant of the first tobacco variety exhibits no or reduced topping-induced suckering compared to a control tobacco plant of the same variety grown under comparable conditions; and selecting for progeny tobacco plants that exhibit no or reduced topping-induced suckering compared to a control tobacco plant of the same cross grown under comparable conditions. In one aspect, a first tobacco variety provided herein comprises modified tobacco plants. In another aspect, a second tobacco variety provided herein comprises modified tobacco plants. In one aspect, a first or second tobacco variety is male sterile. In another aspect, a first or second tobacco variety is cytoplasmically male sterile. In another aspect, a first or second tobacco variety is female sterile. In one aspect, a first or second tobacco variety is an elite variety. In another aspect, a first or second tobacco variety is a hybrid.

In one aspect, the present disclosure provides a method of introgressing one or more transgenes into a tobacco variety, the method comprising: (a) crossing a first tobacco variety comprising one or more transgenes with a second tobacco variety without the one or more transgenes to produce one or more progeny tobacco plants; (b) genotyping the one or more progeny tobacco plants for the one or more transgenes; and (c) selecting a progeny tobacco plant comprising the one or more transgenes. In another aspect, these methods further comprise backcrossing the selected progeny tobacco plant with the second tobacco variety. In further aspects, these methods further comprise: (d) crossing the selected progeny plant with itself or with the second tobacco variety to produce one or more further progeny tobacco plants; and (e) selecting a further progeny tobacco plant comprising the one or more transgenes. In one aspect, the second tobacco variety is an elite variety.

In one aspect, the present disclosure provides a method of introgressing one or more mutations into a tobacco variety, the method comprising: (a) crossing a first tobacco variety comprising one or more mutations with a second tobacco variety without the one or more mutations to produce one or more progeny tobacco plants; (b) genotyping the one or more progeny tobacco plants for the one or more mutations; and (c) selecting a progeny tobacco plant comprising the one or more mutations. In another aspect, these methods further comprise backcrossing the selected progeny tobacco plant with the second tobacco variety. In further aspects, these methods further comprise: (d) crossing the selected progeny plant with itself or with the second tobacco variety to produce one or more further progeny tobacco plants; and (e) selecting a further progeny tobacco plant comprising the one or more mutations. In one aspect, the second tobacco variety is an elite variety.

In one aspect, the present disclosure provides a method of growing a population of modified tobacco plants comprising no or reduced suckering, where the method comprises planting a population of tobacco seeds comprising one or more mutations, one or more transgenes, or both, where the one or more modified tobacco plants exhibit no or reduced suckering compared to control tobacco plants of the same variety when grown under comparable conditions.

In one aspect, the present disclosure provides a method of growing a modified tobacco plant comprising planting a modified tobacco seed comprising a heterologous promoter that is operably linked to a polynucleotide encoding a polypeptide having at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, 255; and growing the modified tobacco plant from the seed. In another aspect, this disclosure provides a method of growing a modified tobacco plant comprising planting a modified tobacco seed comprising a recombinant DNA construct comprising a heterologous promoter that is functional in an L1 layer, an L2 layer, an L3 region, a rib zone, a central zone, a peripheral zone, or a combination thereof, and is operably linked to a polynucleotide that encodes a non-coding RNA molecule, where the non-coding RNA molecule is capable of binding to an RNA encoding a polypeptide having at least 40%, at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 70, 72, 74, 76, 78, 161-185, 187, 189, 191, 197, 199, 224, 229, 231, 233, 235, 237, 239, 241, 243, 245, 247, 249, 251, 253, 255, and where the non-coding RNA molecule suppresses the expression of the polypeptide; and growing the modified tobacco plant the the seed. In an aspect, growing comprises germinating a seed. In another aspect, growing comprises placing a seedling in soil, agar, agar-based media, or a hydroponics system. In another aspect, growing comprises providing a seed or plant with water, light (e.g., artificial light, sunlight), fertilizer, a rooting media, or a combination thereof. In an aspect, growing can take place indoors (e.g., a greenhouse) or outdoors (e.g., a field). In one aspect, growing comprises placing a seed or a plant in a container.

In one aspect, this disclosure provides a method for manufacturing a modified seed, comprising introducing a recombinant DNA construct provided herein into a plant cell; screening a population of plant cells for the recombinant DNA construct; selecting one or more plant cells from the population; generating one or more modified plants from the one or more plant cells; and collecting one or more modified seeds from the one or more modified plants.

As used herein, "locus" is a chromosome region where a polymorphic nucleic acid, trait determinant, gene, or marker is located. The loci of this disclosure comprise one or more polymorphisms in a population; e.g., alternative alleles are present in some individuals. As used herein, "allele" refers to an alternative nucleic acid sequence at a particular locus. The length of an allele can be as small as 1 nucleotide base, but is typically larger. For example, a first allele can occur on one chromosome, while a second allele occurs on a second homologous chromosome, e.g., as occurs for different chromosomes of a heterozygous individual, or between different homozygous or heterozygous individuals in a population. As used herein, a chromosome in a diploid plant is "hemizygous" when only one copy of a locus is present. For example, an inserted transgene is hemizygous when it only inserts into one sister chromosome (i.e., the second sister chromosome does not contain the inserted transgene).

In one aspect, a modified plant, seed, plant component, plant cell, or plant genome is homozygous for a transgene provided herein. In another aspect, a modified plant, seed, plant component, plant cell, or plant genome is heterozygous for a transgene provided herein. In one aspect, a modified plant, seed, plant component, plant cell, or plant genome is hemizygous for a transgene provided herein. In one aspect, a modified plant, seed, plant component, plant cell, or plant genome is homozygous for a mutation provided herein. In another aspect, a modified plant, seed, plant component, plant cell, or plant genome is heterozygous for a mutation provided herein. In one aspect, a modified plant, seed, plant component, plant cell, or plant genome is hemizygous for a mutation provided herein.

As used herein, "introgression" or "introgress" refers to the transmission of a desired allele of a genetic locus from one genetic background to another.

As used herein, "crossed" or "cross" means to produce progeny via fertilization (e.g. cells, seeds or plants) and includes crosses between different plants (sexual) and self-fertilization (selfing).

As used herein, "backcross" and "backcrossing" refer to the process whereby a progeny plant is repeatedly crossed back to one of its parents. In a backcrossing scheme, the "donor" parent refers to the parental plant with the desired gene or locus to be introgressed. The "recipient" parent (used one or more times) or "recurrent" parent (used two or more times) refers to the parental plant into which the gene or locus is being introgressed. The initial cross gives rise to the $F_1$ generation. The term "BC1" refers to the second use of the recurrent parent, "BC2" refers to the third use of the recurrent parent, and so on. In one aspect, a backcross is performed repeatedly, with a progeny individual of each successive backcross generation being itself backcrossed to the same parental genotype.

As used herein, "elite variety" means any variety that has resulted from breeding and selection for superior agronomic performance.

As used herein, "selecting" or "selection" in the context of breeding refer to the act of picking or choosing desired individuals, normally from a population, based on certain pre-determined criteria.

In one aspect, tobacco plants provided herein are hybrid plants. Hybrids can be produced by preventing self-pollination of female parent plants (e.g., seed parents) of a first variety, permitting pollen from male parent plants of a second variety to fertilize the female parent plants, and allowing $F_1$ hybrid seeds to form on the female plants. Self-pollination of female plants can be prevented by emasculating the flowers at an early stage of flower development. Alternatively, pollen formation can be prevented on the female parent plants using a form of male sterility. For example, male sterility can be produced by male sterility (MS), or transgenic male sterility where a transgene inhibits microsporogenesis and/or pollen formation, or self-incompatibility. Female parent plants containing MS are particularly useful. In aspects in which the female parent plants are MS, pollen may be harvested from male fertile plants and applied manually to the stigmas of MS female parent plants, and the resulting $F_1$ seed is harvested. Additionally, female sterile plants can also be used to prevent self-fertilization.

Plants can be used to form single-cross tobacco $F_1$ hybrids. Pollen from a male parent plant is manually transferred to an emasculated female parent plant or a female parent plant that is male sterile to form $F_1$ seed. Alternatively, three-way crosses can be carried out where a single-cross $F_1$ hybrid is used as a female parent and is crossed with a different male parent. As another alternative, double-cross hybrids can be created where the $F_1$ progeny of two different single-crosses are themselves crossed. Self-incompatibility can be used to particular advantage to prevent self-pollination of female parents when forming a double-cross hybrid.

In one aspect, a tobacco variety provided herein is male sterile. In another aspect, a tobacco variety provided herein is cytoplasmic male sterile (CMS). Male sterile tobacco plants may be produced by any method known in the art. Methods of producing male sterile tobacco are described in Wernsman, E. A., and Rufty, R. C. 1987. Chapter Seventeen. Tobacco. Pages 669-698 In: Cultivar Development. Crop Species. W. H. Fehr (ed.), MacMillan Publishing Co., Inc., New York, N.Y. 761 pp. In another aspect, a tobacco variety provided herein is female sterile. As a non-limiting example, female sterile plants can be made by mutating the STIG1 gene. See, for example, Goldman et al. 1994, *EMBO Journal* 13:2976-2984.

As used herein, the term "sequence identity" or "identity" in the context of two polynucleotide or polypeptide sequences makes reference to the residues in the two sequences that are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. When sequences differ in conservative substitutions, the percent sequence identity may be adjusted upwards to correct for the conservative nature of the substitution. Sequences that differ by such conservative substitutions are said to have "sequence similarity" or "similarity."

The use of the term "polynucleotide" is not intended to limit the present disclosure to polynucleotides comprising DNA. Those of ordinary skill in the art will recognize that polynucleotides and nucleic acid molecules can comprise ribonucleotides and combinations of ribonucleotides and deoxyribonucleotides. Such deoxyribonucleotides and ribonucleotides include both naturally occurring molecules and synthetic analogues. The polynucleotides of the present disclosure also encompass all forms of sequences including, but not limited to, single-stranded forms, double-stranded forms, hairpins, stem-and-loop structures, and the like.

As used herein, the term "polypeptide" refers to a chain of at least two covalently linked amino acids.

The present disclosure provides recombinant, purified, isolated, or processed nucleic acids and polypeptides. In one aspect, the present disclosure provides a nucleic acid molecule comprising at least about 40%, about 45%, about 50%, about 55%, about 60%, about 65%, about 70%, about 75%, about 80%, about 85%, about 90%, about 91%, about 92%, about 93%, about 94%, about 95%, about 96%, about 97%, about 98%, about 99%, or about 100% identity to a sequence selected from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83-160, 186, 188, 190, 192, 194, 196, 198, 200, 202, 204, 205, 207, 209, 211, 213, 215, 217, 219, 221, 223, 225-228, 230, 232, 234, 236, 238, 240, 242, 244, 246, 248, 250, 252, 254, and fragments thereof. In one aspect, the present disclosure provides a nucleic acid molecule comprising at least 18, at least 19, at least 20, at least 21, at least 22, at least 23, at least 24, at least 25, at least 26, at least 27, at least 28, at least 29, at least 30, or more than 30 contiguous nucleotides identical to a polynucleotide selected from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83-160, 186, 188, 190, 192, 194, 196, 198, 200, 202, 204, 205, 207, 209, 211, 213, 215, 217, 219, 221, 223, 225-228, 230, 232, 234, 236, 238, 240, 242, 244, 246, 248, 250, 252, and 254.

In another aspect, the present disclosure provides a polynucleotide encoding a polypeptide comprising at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, about 98%, at least about 99%, or about 100% sequence identity to a polypeptide sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255. In another aspect, the present disclosure provides a polynucleotide encoding a polypeptide comprising at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or about 100% similarity to a polypeptide sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

In one aspect, the present disclosure provides a polypeptide comprising at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or about 100% identity to an amino acid sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255. In one aspect, the present disclosure provides a polypeptide comprising at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or about 100% similarity to an amino acid sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255. In one aspect, the present disclosure provides a polypeptide comprising at least 10, at least 11, at least 12, at least 13, at least 14, at least 15, at least 16, at least 17, at least 18, at least 19, at least 20, at least 21, at least 22, at least 23, at least 24, at least 25, at least 30, at least 40, at least 50, or more than 50 contiguous amino acid residues identical to an amino acid sequence in a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255.

In another aspect, the present disclosure provides a biologically active variant of a protein having an amino acid sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255. A biologically active variant of a protein of the present disclosure may differ from that protein by as few as 1-15 amino acid residues, as few as 10, as few as 9, as few as 8, as few as 7, as few as 6, as few as 5, as few as 4, as few as 3, as few as 2, or as few as 1 amino acid residue. Also provided herein are orthologous genes or proteins of genes or proteins selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, and 255. "Orthologs" are genes derived from a common ancestral gene and which are found in different species as a result of speciation. Orthologs may share at least 60%, at least 70%, at least 75%, at least 80%, at least 85%, at least 90%, at least 91%, at least 92%, at least 93%, at least 94%, at least 95%, at least 96%, at least 97%, at least 98%, at least 99%, or greater sequence identity or similarity at the nucleotide sequence and/or the amino acid sequence level. Functions of orthologs are often highly conserved among species.

Nucleic acid molecules, polypeptides, or proteins provided herein can be isolated or substantially purified. An "isolated" or "purified" nucleic acid molecule, polypeptide, protein, or biologically active portion thereof, is substantially or essentially free from components that normally accompany or interact with the polynucleotide or protein as found in its naturally occurring environment. For example, an isolated or purified polynucleotide or protein is substantially free of other cellular material, or culture medium when produced by recombinant techniques, or substantially free of chemical precursors or other chemicals when chemically synthesized. In one aspect, an isolated polynucleotide provided herein can contain less than about 5000 nucleotides, less than about 4000 nucleotides, less than about 3000 nucleotides, less than about 2000 nucleotides, less than about 1000 nucleotides, less than about 500 nucleotides, or less than about 100 nucleotides of nucleic acid sequence that naturally flank the polynucleotide in genomic DNA of the cell from which the polynucleotide is derived. In one aspect, an isolated polynucleotide provided herein can contain 100-5000, 500-5000, 1000-5000, 2000-5000, 3000-5000, 4000-5000, 1-500, 1-1000, 1-2000, 1-3000, 1-4000, 1-5000, 100-500, 100-1000, 100-2000, 100-3000, or 100-4000 nucleotides of nucleic acid sequence that naturally flank the polynucleotide in genomic DNA of the cell from which the polynucleotide is derived. In another aspect, an isolated polypeptide provided herein is substantially free of cellular material in preparations having less than about 30%, less than about 20%, less than about 10%, less than about 5%, or less than about 1% (by dry weight) of chemical precursors or non-protein-of-interest chemicals. Fragments of the disclosed polynucleotides and polypeptides encoded thereby are also encompassed by the present invention. Fragments of a polynucleotide may encode polypeptide fragments that retain the biological activity of the native polypeptide. Alternatively, fragments of a polynucleotide that are useful as hybridization probes or PCR primers using methods known in the art generally do not encode fragment polypeptides retaining biological activity. Fragments of a polynucleotide provided herein can range from at least about 20 nucleotides, about 50 nucleotides, about 70 nucleotides, about 100 nucleotides, about 150 nucleotides, about 200 nucleotides, about 250 nucleotides, about 300 nucleotides, and up to the full-length polynucleotide encoding the polypeptides of the invention, depending on the desired outcome.

Nucleic acids can be isolated using techniques routine in the art. For example, nucleic acids can be isolated using any method including, without limitation, recombinant nucleic acid technology, and/or the polymerase chain reaction (PCR). General PCR techniques are described, for example in PCR Primer: A Laboratory Manual, Dieffenbach & Dveksler, Eds., Cold Spring Harbor Laboratory Press, 1995. Recombinant nucleic acid techniques include, for example, restriction enzyme digestion and ligation, which can be used to isolate a nucleic acid. Isolated nucleic acids also can be chemically synthesized, either as a single nucleic acid molecule or as a series of oligonucleotides. Polypeptides can be purified from natural sources (e.g., a biological sample) by known methods such as DEAE ion exchange, gel filtration, and hydroxyapatite chromatography. A polypeptide also can be purified, for example, by expressing a nucleic acid in an expression vector. In addition, a purified polypeptide can be obtained by chemical synthesis. The extent of purity of a polypeptide can be measured using any appropriate method, e.g., column chromatography, polyacrylamide gel electrophoresis, or HPLC analysis.

In one aspect, this disclosure provides methods of detecting recombinant nucleic acids and polypeptides in plant cells. Without being limiting, nucleic acids also can be detected using hybridization. Hybridization between nucleic acids is discussed in detail in Sambrook et al. (1989, Molecular Cloning: A Laboratory Manual, 2nd Ed., Cold Spring Harbor Laboratory Press, Cold Spring Harbor, N.Y.).

Polypeptides can be detected using antibodies. Techniques for detecting polypeptides using antibodies include enzyme linked immunosorbent assays (ELISAs), Western blots, immunoprecipitations and immunofluorescence. An antibody provided herein can be a polyclonal antibody or a monoclonal antibody. An antibody having specific binding affinity for a polypeptide provided herein can be generated using methods well known in the art. An antibody provided herein can be attached to a solid support such as a microtiter plate using methods known in the art.

Detection (e.g., of an amplification product, of a hybridization complex, of a polypeptide) can be accomplished using detectable labels. The term "label" is intended to encompass the use of direct labels as well as indirect labels. Detectable labels include enzymes, prosthetic groups, fluorescent materials, luminescent materials, bioluminescent materials, and radioactive materials.

The following exemplary, non-limiting embodiments are envisioned:

1. A modified tobacco plant comprising no or reduced suckers compared to a control tobacco plant of the same variety when grown under comparable conditions.
2. The modified tobacco plant of embodiment 1, wherein said suckers is topping-induced suckers.
3. The modified tobacco plant of embodiment 1, wherein said modified tobacco plant comprises one or more mutations.
4. The modified tobacco plant of embodiment 1, wherein said modified tobacco plant comprises one or more transgenes.
5. The modified tobacco plant of embodiment 3, wherein said one or more mutations suppress suckers.
6. The modified tobacco plant of embodiment 4, wherein said one or more transgenes suppress suckers.
7. The modified tobacco plant of embodiment 3, wherein said one or more mutations suppress topping-induced suckers.
8. The modified tobacco plant of embodiment 4, wherein said one or more transgenes suppress topping-induced suckers.
9. The modified tobacco plant of embodiment 3, wherein said one or more mutations suppress suckers prior to topping.
10. The modified tobacco plant of embodiment 4, wherein said one or more transgenes suppress suckers prior to topping.
11. The modified tobacco plant of embodiment 3, wherein said one or more mutations are selected from the group consisting of an insertion, a deletion, an inversion, a substitution, and a combination thereof.

12. The modified tobacco plant of embodiment 4, wherein said one or more transgenes comprise an axillary meristem-specific promoter.
13. The modified tobacco plant of embodiment 12, wherein said axillary meristem-specific promoter is functional or preferentially functional in an L1 layer, an L2 layer, an L3 region, or a combination thereof.
14. The modified tobacco plant of embodiment 12, wherein said axillary meristem-specific promoter is functional or preferentially functional in a central zone, a peripheral zone, a rib zone, or a combination thereof of an axillary meristem.
15. The modified tobacco plant of embodiment 11, wherein said one or more mutations is introduced via a system selected from the group consisting of chemical mutagenesis, irradiation mutagenesis, transposon mutagenesis, *Agrobacterium*-mediated transformation, a meganuclease, a zinc-finger nuclease (ZFN), a transcription activator-like effector nuclease (TALEN), a clustered regularly-interspaced short palindromic repeats (CRISPR)/Cas9 system, a CRISPR/Cpf1 system, and a combination thereof.
16. The modified tobacco plant of embodiment 11, wherein said one or more mutations are in a gene encoding a polypeptide having at least 70% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 58, 60, 62, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, 255.
17. The modified tobacco plant of embodiment 3 or 4, wherein said modified tobacco plant has a similar or higher leaf yield compared to said control tobacco plant when grown under comparable conditions.
18. The modified tobacco plant of embodiment 17, wherein said higher leaf yield is at least 0.5%, 1%, 2.5%, 5%, 10%, 15%, or at least 20% higher.
19. The modified tobacco plant of embodiment 3 or 4, wherein said modified tobacco plant has a similar plant height compared to said control tobacco plant when grown under comparable conditions.
20. The modified tobacco plant of embodiment 19, wherein said similar plant height is within 1%, 5%, 10%, 20%, or 25%.
21. The modified tobacco plant of embodiment 3 or 4, wherein said modified tobacco plant has a similar cured leaf chemistry profile compared to said control tobacco plant when grown under comparable conditions.
22. The modified tobacco plant of embodiment 3 or 4, wherein said modified tobacco plant produces cured leaves that have a similar or higher USDA grade index value compared to cured leaves from said control tobacco plant when grown under comparable conditions.
23. The modified tobacco plant of embodiment 1, wherein said reduced topping-induced suckers comprises fewer total suckers, smaller suckers, or both when compared to topping-induced suckers of a control tobacco plant when grown under comparable conditions.
24. The modified tobacco plant of embodiment 23, wherein said smaller suckers comprise reduced mass, reduced length, or both when compared to topping-induced suckers of a control tobacco plant when grown under comparable conditions.
25. The modified tobacco plant of embodiment 3 or 4, wherein said modified tobacco plant requires reduced management for controlling suckers compared to a control tobacco plant when grown under comparable conditions.
26. The modified tobacco plant of embodiment 25, wherein said reduced management comprises reduced manual removal frequency to control suckers, reduced chemical application frequency to control suckers, reduced quantities of chemical application to control suckers, or any combination thereof compared to a control tobacco plant when grown under comparable conditions.
27. The modified tobacco plant of embodiment 26, wherein said reduced manual removal frequency to control suckers comprises less than 10%, less than 20%, less than 30%, less than 40%, less than 50%, less than 60%, less than 70%, less than 75%, less than 80%, less than 85%, less than 90%, or less than 95% as frequently as a control plant when grown under comparable conditions.
28. The modified tobacco plant of embodiment 3 or 4, wherein said modified tobacco plant is homozygous for said one or more transgenes or said one or more mutations.
29. The modified tobacco plant of embodiment 3 or 4, wherein said modified tobacco plant is hemizygous for said one or more transgenes or said one or more mutations.
30. The modified tobacco plant of embodiment 3 or 4, wherein said modified tobacco plant is heterozygous for said one or more transgenes or said one or more mutations.
31. The modified tobacco plant of embodiment 1, wherein said plant is selected from the group consisting of a flue-cured variety, a bright variety, a Burley variety, a Virginia variety, a Maryland variety, a dark variety, an Oriental variety, and a Turkish variety.
32. The modified tobacco plant of embodiment 1, wherein said tobacco plant is selected from the group consisting a BU 64 plant, a CC 101 plant, a CC 200 plant, a CC 13 plant, a CC 27 plant, a CC 33 plant, a CC 35 plant, a CC 37 plant, a CC 65 plant, a CC 67 plant, a CC 301 plant, a CC 400 plant, a CC 500 plant, CC 600 plant, a CC 700 plant, a CC 800 plant, a CC 900 plant, a CC 1063 plant, a Coker 176 plant, a Coker 319 plant, a Coker 371 Gold plant, a Coker 48 plant, a CU 263 plant, a DF911 plant, a Galpao plant, a GL 26H plant, a GL 338 plant, a GL 350 plant, a GL 395 plant, a GL 600 plant, a GL 737 plant, a GL 939 plant, a GL 973 plant, a GF 157 plant, a GF 318 plant, an RJR 901 plant, an HB 04P plant, a K 149 plant, a K 326 plant, a K 346 plant, a K 358 plant, a K394 plant, a K 399 plant, a K 730 plant, an NC 196 plant, an NC 37NF plant, an NC 471 plant, an NC 55 plant, an NC 92 plant, an NC2326 plant, an NC 95 plant, an NC 925 plant, a PVH 1118 plant, a PVH 1452 plant, a PVH 2110 plant, a PVH 2254 plant, a PVH 2275 plant, a VA 116 plant, a VA 119 plant, a KDH 959 plant, a KT 200 plant, a KT204LC plant, a KY 10 plant, a KY 14 plant, a KY 160 plant, a KY 17 plant, a KY 171 plant, a KY 907 plant, a KY 907LC plant, a KTY14×L8 LC plant, a Little Crittenden plant, a McNair 373 plant, a McNair 944 plant, a male sterile KY 14×L8 plant, a Narrow Leaf Madole plant, a MS KY171 plant, a Narrow Leaf Madole (phph) plant, a MS Narrow Leaf Madole plant, a MS TND950 plant, a PD 7302LC plant, a PD 7305LC plant, a PD 7309LC plant, a PD 7312LC plant, a PD 7318LC plant, a PD 7319LC plant, a MSTKS 2002 plant, a TKF 2002 plant, a TKF 6400 plant, a TKF 4028 plant, a TKF 4024 plant, a KT206LC plant, a KT209LC plant, a KT210LC plant, a KT212LC plant, an NC 100 plant, an NC 102 plant, an NC 2000 plant, an NC 291 plant, an NC 297 plant, an NC 299 plant, an NC 3 plant, an NC 4 plant, an NC 5 plant, an NC 6 plant, an NC7 plant, an NC 606 plant, an NC 71 plant, an NC 72 plant, an NC 810 plant, an NC BH 129 plant, an NC 2002 plant, a Neal Smith Madole plant, an OXFORD 207 plant, a 'Perique' plant, a PVH03 plant, a PVH09 plant, a PVH19 plant, a PVH50 plant, a PVH51 plant, an R 610 plant, an R 630 plant, an R 7-11 plant, an R 7-12 plant, an RG 17 plant, an RG 81 plant, an RG H51 plant, an RGH 4 plant, an RGH 51 plant, an RS 1410 plant, a Speight 168 plant, a Speight 172 plant, a Speight 179 plant, a Speight 210 plant, a Speight 220 plant, a Speight 225 plant, a Speight 227 plant, a Speight 234 plant, a Speight G-28 plant, a Speight G-70 plant, a Speight H-6 plant, a Speight H20 plant, a Speight NF3 plant, a TI 1406 plant, a TI 1269 plant, a TN 86 plant, a TN86LC plant, a TN 90 plant, a TN90LC plant, a TN 97 plant, a TN97LC plant, a TN D94 plant, a TN D950 plant, a TR (Tom Rosson) Madole plant, a VA 309 plant, and a VA 359 plant.
33. The modified tobacco plant of embodiment 1, wherein said modified tobacco plant is a hybrid.
34. The modified tobacco plant of embodiment 1, wherein said modified tobacco plant is male sterile or cytoplasmically male sterile (CMS).
35. The modified tobacco plant of embodiment 1, wherein said modified tobacco plant is female sterile.
36. A tobacco leaf of the modified tobacco plant of embodiment 1.
37. The tobacco leaf of embodiment 35, wherein said tobacco leaf is a cured tobacco leaf.
38. The tobacco leaf of embodiment 36, wherein said cured tobacco leaf is air-cured, fire-cured, sun-cured, or flue-cured.
39. A tobacco product comprising cured tobacco material from the modified tobacco plant of embodiment 1.
40. The tobacco product of embodiment 39, wherein said tobacco product is selected from the group consisting of a cigarette, a kretek, a bidi cigarette, a cigar, a cigarillo, a non-ventilated cigarette, a vented recess filter cigarette, pipe tobacco, snuff, chewing tobacco, moist smokeless tobacco, fine cut chewing tobacco, long cut chewing tobacco, pouched chewing tobacco product, gum, a tablet, a lozenge, and a dissolving strip.
41. A seed giving rise to the modified tobacco plant of embodiment 1.
42. A method comprising preparing a tobacco product using a cured tobacco leaf from the modified tobacco plant of embodiment 1.
43. A modified tobacco plant, wherein said modified tobacco plant exhibits:
   a. inhibited or eliminated axillary meristem growth;
   b. inhibited or eliminated axillary meristem maintenance; or
   c. a combination thereof
   compared to a control tobacco plant of the same variety when grown under comparable conditions.
44. A plant or seed comprising a recombinant polynucleotide, wherein said recombinant polynucleotide comprises:
   a. a promoter that is functional in an L1 layer, an L2 layer, an L3 region, a rib zone, a central zone, a peripheral zone, or any combination thereof, which is operably linked to
   b. a structural nucleic acid molecule comprising a nucleic acid sequence, wherein said nucleic acid sequence encodes a polypeptide having at least 70% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 58, 60, 62, 68, 70, 72, 74, 76, 78, 80, 82, 161-185, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, 255.
45. The plant or seed of embodiment 43, wherein said promoter comprises a nucleic acid sequence having at least 90% sequence identity to a polynucleotide selected from the group consisting of SEQ ID NOs: 113-118, 148-160, 204 and fragments thereof.
46. The plant or seed of embodiment 43, wherein said plant or seed is a tobacco plant or seed.
47. A recombinant DNA construct comprising:
   a. a promoter that is functional in an L1 layer, an L2 layer, an L3 region, a rib zone, a central zone, a peripheral zone, or a combination thereof; and
   b. a heterologous and operably linked nucleic acid sequence, wherein said nucleic acid sequence encodes a non-coding RNA or a polypeptide.
48. The recombinant DNA construct of embodiment 46, wherein said promoter comprises a nucleic acid sequence having at least 90% sequence identity to a polynucleotide selected from the group consisting of SEQ ID NOs: 113-118, 148-160, 204 and fragments thereof.
49. A method of reducing or eliminating topping-induced suckers in a tobacco plant, said method comprising transforming a tobacco plant with a recombinant DNA construct comprising a promoter functional in an L1 layer, an L2 layer, an L3 region, a rib zone, a central zone, a peripheral zone, or a combination thereof.
50. The method of embodiment 48, wherein said promoter comprises a nucleic acid sequence having at least 90% sequence identity to a polynucleotide selected from the group consisting of SEQ ID NOs: 113-118, 148-160, 204 and fragments thereof.
51. A method comprising transforming a tobacco plant with a recombinant DNA construct comprising a heterologous promoter that is functional in an L1 layer, an L2 layer, an L3 region, a rib zone, a central zone, a peripheral zone, or a combination thereof, and is operably linked to a polynucleotide that is transcribed into an RNA molecule that suppresses the level of an endogenous gene, and wherein said endogenous gene promotes or is required for axillary meristem growth, axillary meristem maintenance, or both.
52. A method for producing a tobacco plant comprising:
   a. crossing at least one tobacco plant of a first tobacco variety with at least one tobacco plant of a second tobacco variety, wherein said at least one tobacco plant of said first tobacco variety exhibits no or reduced topping-induced suckers compared to a control tobacco plant of the same variety grown under comparable conditions; and b. selecting for progeny tobacco plants that exhibit no or reduced topping-induced suckers compared to a control tobacco plant of the same cross grown under comparable conditions.

53. A tobacco plant, or part thereof, comprising a heterologous promoter operably linked to a polynucleotide encoding a polypeptide having at least 70% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 68, 70, 72, 74, 76, 78, 80, 82, 161-185, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, 255.

54. The tobacco plant, or part thereof, of embodiment 52, wherein said promoter comprises a nucleic acid molecule having at least 90% sequence identity to a polynucleotide selected from the group consisting of SEQ ID NOs: 113-118, 148-160, 204 and fragments thereof.

55. The tobacco plant, or part thereof, of embodiment 52, wherein said polynucleotide has at least 90% sequence identity to a polynucleotide selected from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 67, 69, 71, 73, 75, 77, 79, 81, 83-160, 186, 188, 190, 192, 194, 196, 198, 200, 202, 204, 205, 207, 209, 211, 213, 215, 217, 219, 221, 223, 228, 230, 232, 234, 236, 238, 240, 242, 244, 246, 248, 250, 252, and 254.

56. The tobacco plant, or part thereof, of embodiment 52, wherein said polypeptide comprises at least 15 contiguous amino acid residues identical to said polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 68, 70, 72, 74, 76, 78, 80, 82, 161-185, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, 255.

57. A recombinant DNA construct comprising a heterologous promoter operably linked to a polynucleotide encoding a polypeptide having at least 70% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 58, 60, 62, 68, 70, 72, 74, 76, 78, 80, 82, 161-185, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, 255.

58. A method of growing a modified tobacco plant comprising planting a modified tobacco seed comprising a heterologous promoter that is operably linked to a polynucleotide encoding a polypeptide having at least 70% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 58, 60, 62, 68, 70, 72, 74, 76, 78, 80, 82, 161-185, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, 255; and growing said modified tobacco plant from said seed.

59. A method for controlling topping-induced suckers in a plant comprising transforming said plant with a recombinant DNA construct, wherein said recombinant DNA construct comprises a promoter that is operably linked to a polynucleotide encoding a polypeptide having at least 70% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 58, 60, 62, 68, 70, 72, 74, 76, 78, 80, 82, 161-185, 187, 189, 191, 193, 195, 197, 199, 201, 203, 206, 208, 210, 212, 214, 216, 218, 220, 222, 224, 229, 231, 233, 235, 237, 239, 241, 243, 245, 247, 249, 251, 253, 255.

60. A tobacco plant, or part thereof, comprising a heterologous promoter operably linked to a polynucleotide that encodes a non-coding RNA molecule, wherein said non-coding RNA molecule is capable of binding to an RNA encoding a polypeptide having at least 70% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 70, 72, 74, 76, 78, 161-185, 187, 189, 191, 197, 199, 224, 229, 231, 233, 235, 237, 239, 241, 243, 245, 247, 249, 251, 253, 255, and wherein said non-coding RNA molecule suppresses the expression of said polypeptide.

61. The tobacco plant, or part thereof, of embodiment 59, wherein said promoter comprises a nucleic acid sequence having at least 90% sequence identity to a polynucleotide selected from the group consisting of SEQ ID NOs: 113-118, 148-160, 204 and fragments thereof.

62. The tobacco plant, or part thereof, of embodiment 59, wherein said polynucleotide has at least 90% sequence identity to a polynucleotide selected from the group consisting of SEQ ID NOs: 83-101.

63. The tobacco plant, or part thereof, of embodiment 59, wherein said polynucleotide comprises at least 18, 19, 20, 21, 22, 23, 24, 25, 26, 27, 28, 29, 30, or more than 30 contiguous nucleotides identical to a polynucleotide selected from the group consisting of SEQ ID NOs: 83-101.

64. A recombinant DNA construct comprising a heterologous axillary meristem-specific promoter operably linked to a polynucleotide that encodes a non-coding RNA molecule, wherein said non-coding RNA molecule is capable of binding to an RNA encoding a polypeptide having at least 70% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 70, 72, 74, 76, 78, 161-185, 187, 189, 191, 197, 199, 224, 229, 231, 233, 235, 237, 239, 241, 243, 245, 247, 249, 251, 253, 255, and wherein said non-coding RNA molecule suppresses the expression of said polypeptide.

65. A method of growing a modified tobacco plant comprising planting a modified tobacco seed comprising a recombinant DNA construct comprising a heterologous promoter that is functional in an L1 layer, an L2 layer, an L3 region, a rib zone, a central zone, a peripheral zone, or a combination thereof, and is operably linked to a polynucleotide that encodes a non-coding RNA molecule, wherein said non-coding RNA molecule is capable of binding to an RNA encoding a polypeptide having at least 70% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 70, 72, 74, 76, 78, 161-185, 187, 189, 191, 197, 199, 224, 229, 231, 233, 235, 237, 239, 241, 243, 245, 247, 249, 251, 253, 255, and wherein said non-coding RNA molecule suppresses the expression of said polypeptide; and growing said modified tobacco plant from said seed.

66. A method for controlling topping-induced suckers in a plant comprising transforming said plant with a recombinant DNA construct, wherein said recombinant DNA construct comprises a heterologous promoter that is functional in an L1 layer, an L2 layer, an L3 region, a rib zone, a central zone, a peripheral zone, or a combination thereof, and wherein said promoter is operably linked to a polynucleotide that encodes a non-coding RNA molecule, wherein said non-coding RNA molecule is capable of binding to an RNA encoding a polypeptide having at least 70% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 70, 72, 74, 76, 78, 161-185, 187, 189, 191, 197, 199, 224, 229, 231, 233, 235, 237, 239, 241, 243, 245, 247, 249, 251, 253, 255, and wherein said non-coding RNA molecule suppresses the expression of said polypeptide.

67. A bacterial cell comprising the recombinant DNA construct of any one of embodiments 46, 56, or 63.

68. A plant genome comprising the recombinant DNA construct of any one of embodiments 46, 56, or 63.

69. A method for manufacturing a modified seed, said method comprising:
   a. introducing the recombinant DNA construct from any one of embodiments 46, 56, or 63 into a plant cell;
   b. screening a population of plant cells for said recombinant DNA construct;
   c. selecting one or more plant cells from said population;
   d. generating one or more modified plants from said one or more plant cells; and
   e. collecting one or more modified seeds from said one or more modified plants.

70. A method of producing a modified tobacco plant to reduce or eliminate suckers, said method comprising introducing one or more mutations in one or more tobacco genome loci.

71. The method of embodiment 69, wherein said one or more mutations are introduced via a system selected from the group consisting of chemical mutagenesis, irradiation mutagenesis, transposon mutagenesis, *Agrobacterium*-mediated transformation, a meganuclease, a ZFN, a TALEN, a CRISPR/Cas9 system, a CRISPR/Cpf1 system, and a combination thereof.

72. A recombinant DNA construct comprising:
   a. a promoter that is functional in an L1 layer, an L2 layer, an L3 region, a rib zone, a central zone, a peripheral zone, or a combination thereof; and
   b. a heterologous and operably linked to an artificial microRNA, wherein said artificial miRNA has at least 70% identity to an RNA encoding a polypeptide having at least 70% sequence identity to a polypeptide selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 70, 72, 74, 76, 78, 161-185, 187, 189, 191, 197, 199, 224, 229, 231, 233, 235, 237, 239, 241, 243, 245, 247, 249, 251, 253, 255, and wherein said artificial microRNA suppresses the expression of said polypeptide.

73. A plant or seed comprising a recombinant polynucleotide, wherein said recombinant polynucleotide comprises:
   a. a promoter that is functional in an L1 layer, an L2 layer, an L3 region, a rib zone, a central zone, a peripheral zone, or any combination thereof, which is operably linked to
   b. a structural nucleic acid molecule comprising a nucleic acid sequence, wherein said nucleic acid sequence encodes an auxin biosynthesis protein or an auxin transport protein.

74. A recombinant DNA construct comprising:
   a. a promoter that is functional in an L1 layer, an L2 layer, an L3 region, a rib zone, a central zone, a peripheral zone, or any combination thereof; and
   b. a heterologous and operably linked nucleic acid sequence, wherein said nucleic acid sequence encodes an auxin biosynthesis protein or an auxin transport protein.

75. A recombinant DNA construct comprising a heterologous axillary meristem-specific promoter operably linked to a polynucleotide that encodes an auxin biosynthesis protein or an auxin transport protein.

76. The recombinant DNA construct of embodiment 74, wherein said auxin biosynthesis protein or auxin transport protein is encoded by a polynucleotide encoding a polypeptide having at least 70% sequence identity to a polypeptide selected from the group consisting of SEQ ID NOs: 235, 237, 239, 241, 243, 245, 247, 249, 251, 253, and 255.

77. A tobacco plant, or part thereof, comprising a heterologous promoter having at least 90% sequence identity to a polynucleotide selected from the group consisting of SEQ ID NOs: 113-118, 148-160, 204, and fragments thereof operably linked to a polynucleotide encoding an auxin biosynthesis protein or an auxin transport protein.

78. The tobacco plant, or part thereof, of embodiment 76, wherein said auxin biosynthesis protein or auxin transport protein is encoded by a polynucleotide encoding a polypeptide having at least 70% sequence identity to a polypeptide selected from the group consisting of SEQ ID NOs: 235, 237, 239, 241, 243, 245, 247, 249, 251, 253, and 255.

79. A method for controlling topping-induced suckers in a plant comprising transforming said plant with a recombinant DNA construct, wherein said recombinant DNA construct comprises a promoter that is operably linked to a polynucleotide encoding an auxin biosynthesis protein or an auxin transport protein.

80. The method of embodiment 78, wherein said auxin biosynthesis protein or auxin transport protein is encoded by a polynucleotide encoding a polypeptide having at least 70% sequence identity to a polypeptide selected from the group consisting of SEQ ID NOs: 235, 237, 239, 241, 243, 245, 247, 249, 251, 253, and 255.

81. The modified tobacco plant of embodiment 23, wherein said fewer total suckers comprises at least 10%, at least 15%, at least 20%, at least 25%, at least 30%, at least 35%, at least 40%, at least 45%, at least 50%, at least 60%, at least 70%, at least 80%, at least 90%, or at least 95% fewer total suckers compared to an unmodified control tobacco plant grown under comparable conditions 82. The modified tobacco plant of embodiment 24, wherein said reduced mass comprises at least 10%, at least 15%, at least 20%, at least 25%, at least 30%, at least 35%, at least 40%, at least 45%, at least 50%, at least 60%, at least 70%, at least 80%, at least 90%, or at least 95% reduced mass compared to the mass of suckers of an unmodified control tobacco plant grown under comparable conditions 83. The modified tobacco plant of embodiment 24, wherein said reduced length comprises at least 10%, at least 15%, at least 20%, at least 25%, at least 30%, at least 35%, at least 40%, at least 45%, at least 50%, at least 60%, at least 70%, at least 80%, at least 90%, or at least 95% reduced length compared to the length of suckers of an unmodified control tobacco plant grown under comparable conditions Having now generally described the disclosure, the same will be more readily understood through reference to the following examples that are provided by way of illustration, and are not intended to be limiting of the present disclosure, unless specified.

EXAMPLES

Example 1. Identification of Topping-Inducible Genes

RNA samples from 4 week old TN90 tobacco plants are obtained from 10 tissue types (axillary buds before topping; axillary buds 2 hours after topping; axillary buds 6 hours after topping; axillary buds 24 hours after topping; axillary buds 72 hours after topping; roots before topping; roots 24 hours after topping; roots 72 hours after topping; young leaf at the time of topping; and shoot apical meristem). The resulting RNA samples (three independently collected samples for each tissue type) are used as starting material for Illumina 1×100 bp sequencing.

Illumina reads are mapped and used to identify a list of candidate genes exhibiting high axillary bud expression. Expression of candidate genes is confirmed using RT-PCR. See U.S. patent application Ser. No. 14/875,928, filed on Oct. 6, 2015, published on Sep. 29, 2016 as US 2016/0281100, which is herein incorporated by reference in its entirety. After confirming candidate genes are differentially expressed in axillary buds, full-length candidate genes are cloned using gene specific primers designed from predicted full-length cDNA sequences (Table 2A). Normalized Illumina read counts for selected loci are provided in Table 2B.

TABLE 2A

Selected full-length candidate tobacco genes exhibiting differential expression in axillary buds

| SEQ ID NO (DNA/peptide) | Coding Sequence | Polynucleotide Length (nucleotides) | Polypeptide Length (amino acids) | Annotation |
|---|---|---|---|---|
| 1/2 | Full length confirmed | 987 | 328 | Transcription factor CYCLOIDEA-like |
| 3/4 | Full length confirmed | 318 | 105 | Flower-specific gamma-thionin |
| 5/6 | Full length confirmed | 1797 | 598 | Polyphenoloxidase |
| 7/8 | Full length confirmed | 1392 | 463 | UDP-glucose:glucosyltransferase |
| 9/10 | Full length confirmed | 405 | 134 | Tumor-related protein |
| 11/12 | Full length confirmed | 630 | 209 | Hypothetical protein |
| 13/14 | Full length confirmed | 1143 | 380 | TCP1 protein-like gene |
| 15/16 | Full length confirmed | 915 | 304 | Chlorophyllase-2 |
| 17/18 | Full length confirmed | 1353 | 450 | AP2/ERF domain-containing transcription factor |
| 19/20 | Full length confirmed | 732 | 243 | Putative miraculin |
| 186/187 | Pseudo gene | 2340 | 87 | (E,E)-geranyllinalool synthase |
| 21/22 | Full length confirmed | 471 | 156 | Oleosin |
| 23/24 | Full length confirmed | 1437 | 478 | ACC synthase |
| 25/26 | Full length confirmed | 645 | 214 | LOB domain-containing protein 18-like |
| 27/28 | Full length confirmed | 2205 | 734 | Vicilin-like antimicrobial peptides cupin super family |
| 29/30 | Full length confirmed | 1302 | 433 | Abscisic acid insensitive |
| 31/32 | Full length confirmed | 1266 | 421 | Seipin-like |
| 33/34 | Full length confirmed | 597 | 198 | Transcription factor CYCLOIDEA-like |
| 35/36 | Full length confirmed | 1038 | 345 | Transcription factor DICHOTOMA-like |
| 37/38 | Full length confirmed | 1014 | 337 | Transcription factor CYCLOIDEA-like |

TABLE 2B

Normalized Illumina read counts for selected candidate genes.

| SEQ ID NO (DNA/Peptide) | Axillary Buds Before Topping | Axillary Buds After Topping | | | | Roots Before Topping | Roots After Topping | | Shoot Apical Meristem | Young Leaf |
|---|---|---|---|---|---|---|---|---|---|---|
| | | 2 hrs | 6 hrs | 24 hrs | 72 hrs | | 24 hrs | 72 hrs | | |
| 1/2 | 1,072 | 998 | 1,346 | 663 | 652 | 7 | 9 | 11 | 180 | 47 |
| 3/4 | 1,387 | 927 | 3,527 | 44,790 | 23,270 | 108 | 90 | 128 | 8,913 | 72 |
| 5/6 | 763 | 1,132 | 1,852 | 5,559 | 2,644 | 110 | 156 | 80 | 513 | 7 |
| 9/10 | 2,342 | 2,357 | 2,992 | 3,143 | 2,190 | 38 | 28 | 27 | 26 | 103 |
| 11/12 | 47 | 29 | 54 | 18 | 17 | 1 | 0 | 0 | 23 | 1 |
| 13/14 | 128 | 131 | 187 | 69 | 54 | 0 | 1 | 1 | 13 | 0 |
| 15/16 | 124 | 308 | 1,619 | 337 | 136 | 217 | 143 | 160 | 88 | 234 |
| 17/18 | 3 | 162 | 186 | 9 | 9 | 22 | 22 | 29 | 6 | 2 |
| 19/20 | 41 | 98 | 334 | 136 | 101 | 1 | 0 | 0 | 50 | 0 |
| 186/187 | 1,479 | 1,486 | 4,216 | 16,176 | 12,228 | 46 | 36 | 33 | 2,144 | 839 |
| 21/22 | 52 | 27 | 81 | 13 | 9 | 2 | 1 | 3 | 5 | 1 |
| 23/24 | 152 | 114 | 135 | 46 | 45 | 2 | 2 | 2 | 1 | 0 |
| 25/26 | 60 | 34 | 22 | 17 | 13 | 2 | 4 | 1 | 30 | 1 |
| 29/30 | 624 | 583 | 1,279 | 300 | 215 | 14 | 9 | 18 | 71 | 9 |
| 31/32 | 176 | 121 | 253 | 95 | 70 | 7 | 1 | 1 | 69 | 27 |
| 33/34 | 268 | 279 | 410 | 231 | 207 | 1 | 1 | 1 | 22 | 11 |
| 35/36 | 193 | 241 | 366 | 117 | 123 | 2 | 2 | 2 | 13 | 1 |
| 37/38 | 394 | 353 | 505 | 207 | 204 | 2 | 2 | 1 | 34 | 2 |

Example 2. Development of Modified Plants

An expression vector, p45-2-7 (SEQ ID NO: 112; FIG. 1), is used as a backbone to generate multiple transformation vectors (See Examples 6-10 and 13-20). p45-2-7 contains a CsVMV promoter, a NOS terminator, and a cassette comprising a kanamycin selection marker (NPT II) operably linked to an Actin2 promoter and a NOS terminator. Nucleic acid vectors comprising transgenes of interest are introduced into tobacco leaf discs via Agrobacterium transformation. See, for example, Mayo et al., 2006, Nat Protoc. 1:1105-11 and Horsch et al., 1985, Science 227:1229-1231.

Narrow Leaf Madole (NLM) tobacco plants are grown in Magenta™ GA-7 boxes and leaf discs are cut and placed into Petri plates. Agrobacterium tumefaciens cells comprising a transformation vector are collected by centrifuging a 20 mL cell suspension in a 50 mL centrifuge tube at 3500 RPM for 10 minutes. The supernatant is removed and the Agrobacterium tumefaciens cell pellet is re-suspended in 40 mL liquid re-suspension medium. Tobacco leaves, avoiding the midrib, are cut into eight 0.6 cm discs with a #15 razor blade and placed upside down in a Petri plate. A thin layer of Murashige & Skoog with B5 vitamins liquid re-suspension medium is added to the Petri plate and the leaf discs are poked uniformly with a fine point needle. About 25 mL of the Agrobacterium tumefaciens suspension is added to the Petri plate and the leaf discs are incubated in the suspension for 10 minutes.

Leaf discs are transferred to co-cultivation Petri plates (½ MS medium) and discs are placed upside down in contact with filter paper overlaid on the co-cultivation TOM medium (MS medium with 20 g/L sucrose; 1 mg/L indole-3-acetic acid; and 2.5 mg/L 6-benzyl aminopurine (BAP)). The Petri plate is sealed with parafilm prior to incubation in dim light (60-80 mE/ms) with 18 hours on, 6 hours off photoperiods at 24 degrees Celsius for three days. After incubation, leaf discs are transferred to regeneration/selection TOM K medium Petri plates (TOM medium plus 300 mg/L kanamycin). Leaf discs are sub-cultured bi-weekly to fresh TOM K medium in dim light with 18 hours on, 6 hours off photoperiods at 24 degrees Celsius until shoots become excisable. Shoots from leaves are removed with forceps and inserted in MS basal medium with 100 mg/L kanamycin. Shoots on MS basal medium with 100 mg/L kanamycin are incubated at 24 degrees Celsius with 18 hours on, 6 hours off photoperiods with high intensity lighting (6080 mE/ms) to induce rooting.

When plantlets containing both shoots and roots grow large enough (e.g., reach approximately half the height of a Magenta™ GA-7 box), they are transferred to soil. Established seedlings are transferred to a greenhouse for further analysis and to set seed. Evaluation of suckering phenotypes is conducted by growing modified plants (T0, T1, T2, or later generations) and control plants to layby stage. Control plants are either NLM plants that have not been transformed or NLM plants that have been transformed with an empty p45-2-7 vector. Plants that have reached layby stage are manually topped (the shoot apical meristem and surrounding tissue is removed), and axillary bud growth is evaluated at specific time points after topping. Observations are typically performed at the time of topping (i.e., 0 hours), 24 hours (i.e., 1 day) after topping, 7-8 days after topping (i.e., one week), and/or 14-15 days (i.e., two weeks) after topping. Observations comprise qualitatively examining the presence or absence of axillary bud growth and overall plant appearance. Observations also comprise quantitatively measuring the fresh weight of all axillary buds at a specific time point after topping and/or measuring the length of all axillary bud outgrowths at a specific time point after topping.

Example 3. Identification of Tobacco Genes that Function in Sucker Development

Transformation vectors and modified tobacco plants are generated to over-express full-length coding sequences from tobacco genes (e.g., SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 57, 59, and 69).

As an illustration, SEQ ID NO: 11 is incorporated into a p45-2-7 transformation vector, and modified tobacco plants are generated, according to Example 2. Modified tobacco plants (T0 generation) and control tobacco plants are grown to the layby stage, then plants are topped to remove the shoot apical meristem according to Example 2. Sucker growth is evaluated at the time of topping and one week after topping.

Figure 2:
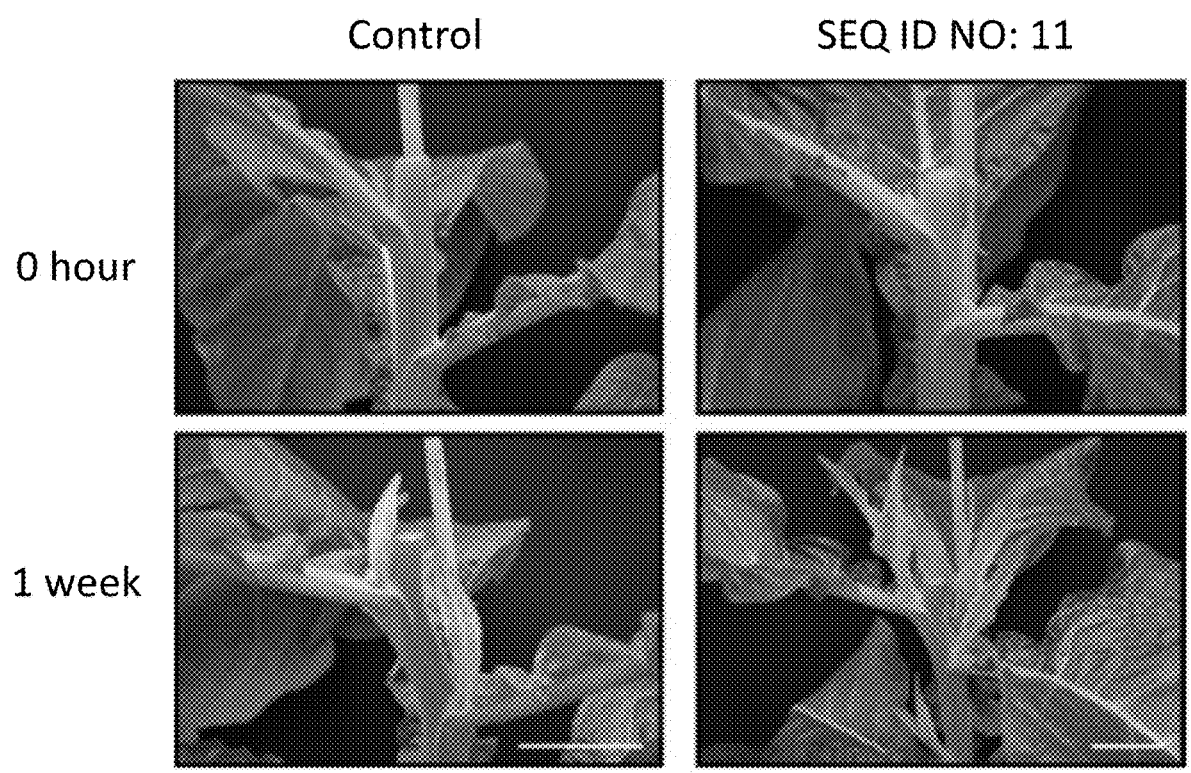
FIG. 2 shows photographs of control tobacco plants and modified tobacco plants that overexpress SEQ ID NO: 11, which encodes a product that promotes sucker growth in tobacco. Plants are shown at the time of topping (0 hour) and one week after topping. Modified plants exhibit increased sucker growth compared to control plants.

Overexpression of SEQ ID NO:11 increases bud outgrowth in tobacco, indicating expression of SEQ ID NO: 11 promotes sucker growth (FIG. 2).

Example 4. Expression of Non-Tobacco Origin Genes that Affect Tobacco Sucker Growth Multiple genes have been identified to play a role in sucker growth in non-tobacco species. Transformation vectors and modified tobacco plants are generated to express non-tobacco origin full-length genes (e.g., SEQ ID NOs: 55, 67, 79, and 81). SEQ ID NO: 81 (encoding *Arabidopsis thaliana* BRANCHED1 (BRC1)) is incorporated into a p45-2-7 transformation vector and modified tobacco plants are generated according to Example 2. In *Arabidopsis*, BRC1 is expressed in developing buds, where it functions to arrest bud development. See, for example, González-Grandio et al., 2013, *Plant Cell* 25: 834-850, which is herein incorporated by reference in its entirety.

Figure 3A:
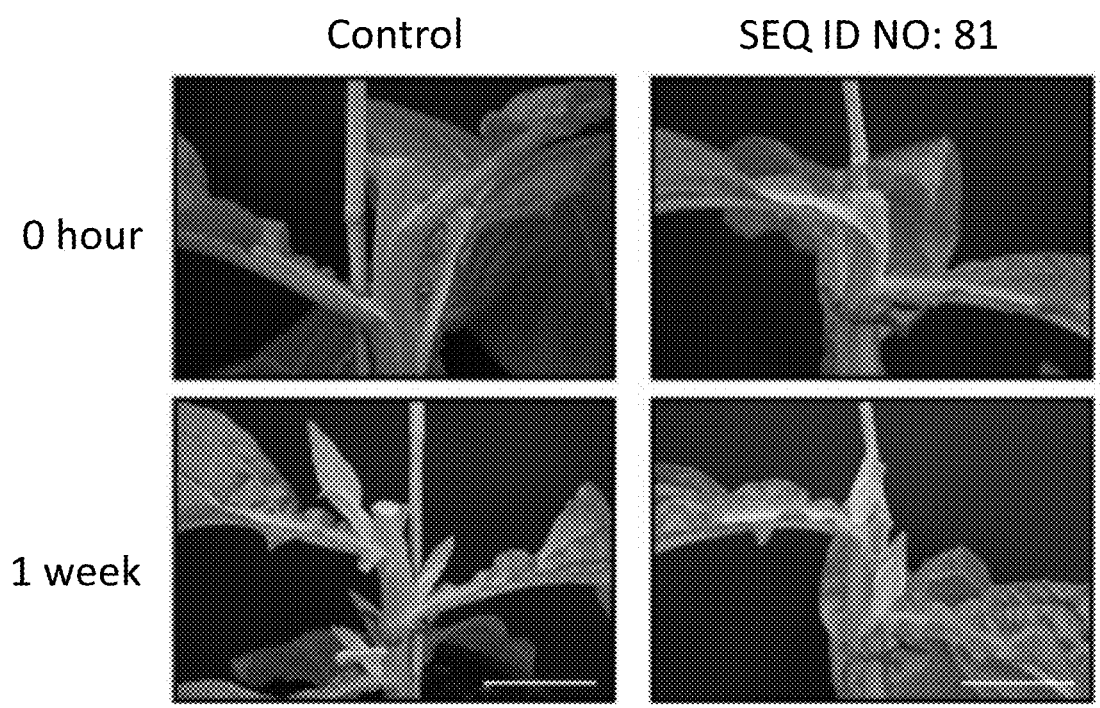
FIG. 3A shows plants at the time of topping (0 hour) and one week after topping. Modified plants exhibit decreased sucker growth compared to control plants.
Figure 3B:
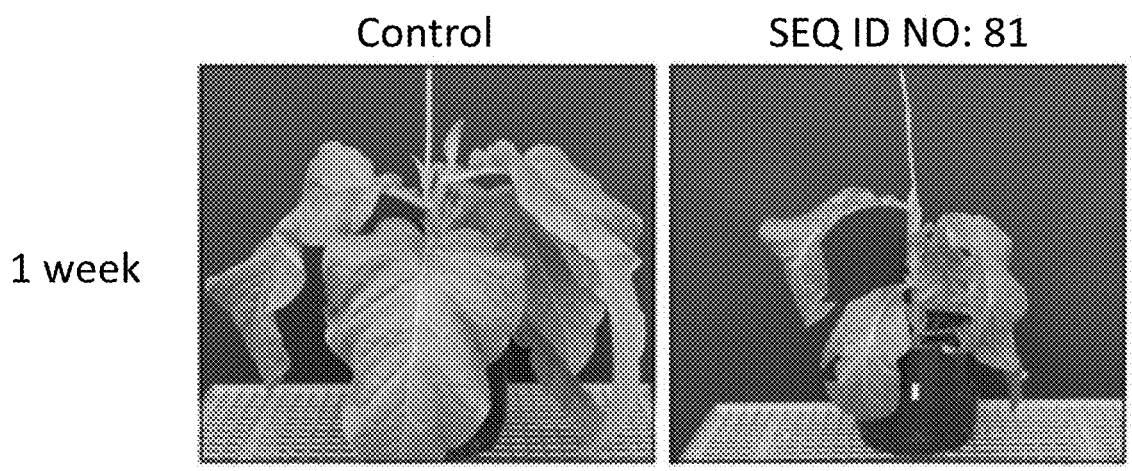
FIG. 3B shows that modified plants overexpressing SEQ ID NO: 81 exhibit stunted growth compared to control plants.

Modified tobacco plants (T0 generation) and control tobacco plants are grown to the layby stage, then plants are topped to remove the shoot apical meristem according to Example 2. Sucker growth is evaluated at the time of topping and one week after topping (FIG. 3A). Expression of SEQ ID NO: 81 in tobacco reduces bud outgrowth. These plants also exhibit stunted growth (FIG. 3B).

Example 5. Identification of Native Tobacco Genes that Inhibit Sucker Growth

Transformation vectors and modified tobacco plants are generated to use RNAi to inhibit endogenous tobacco genes (e.g., SEQ ID NOs: 83-107) and identify their role in sucker outgrowth.

Three tobacco genes (SEQ ID NOs: 1, 13, and 35) are identified as TCP-family proteins having homology to *Arabidopsis* BRC1. Transformation vectors and modified tobacco plants are generated according to Example 2; resulting modified tobacco plants are phenotypically evaluated after topping according to Example 2.

Figure 4:
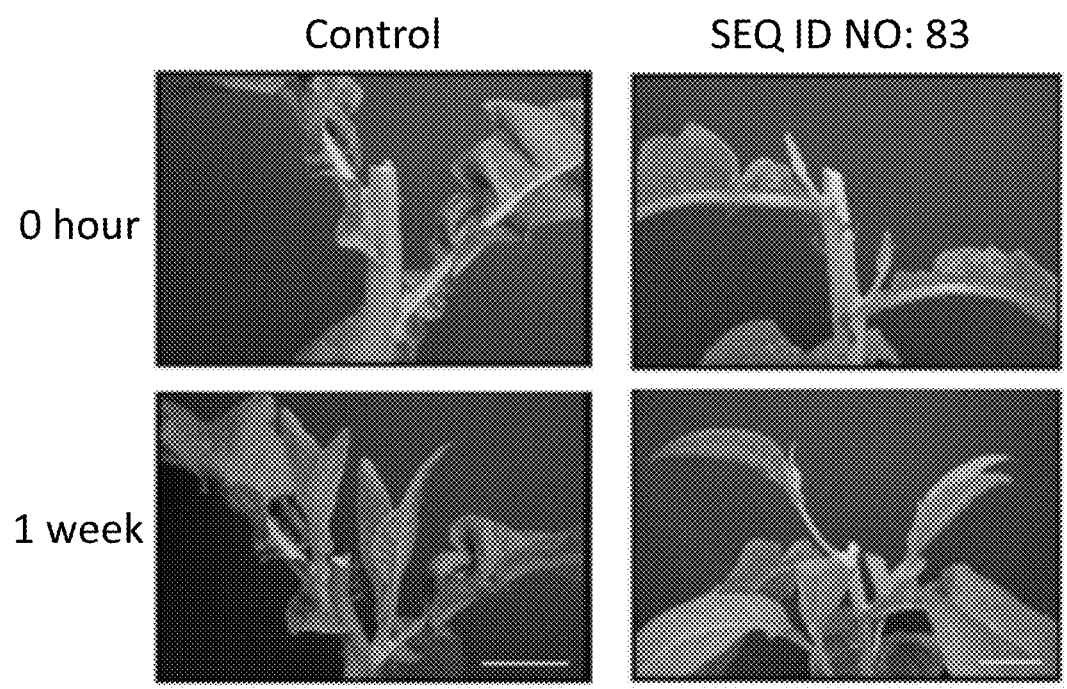
FIG. 4 shows photographs of control tobacco plants and modified tobacco plants that express SEQ ID NO: 83, an RNAi construct that targets SEQ ID NO: 1 for inhibition. Plants are shown at the time of topping (0 hour) and one week after topping. Modified plants exhibit enhanced suckering compared to control plants.
Figure 5A:
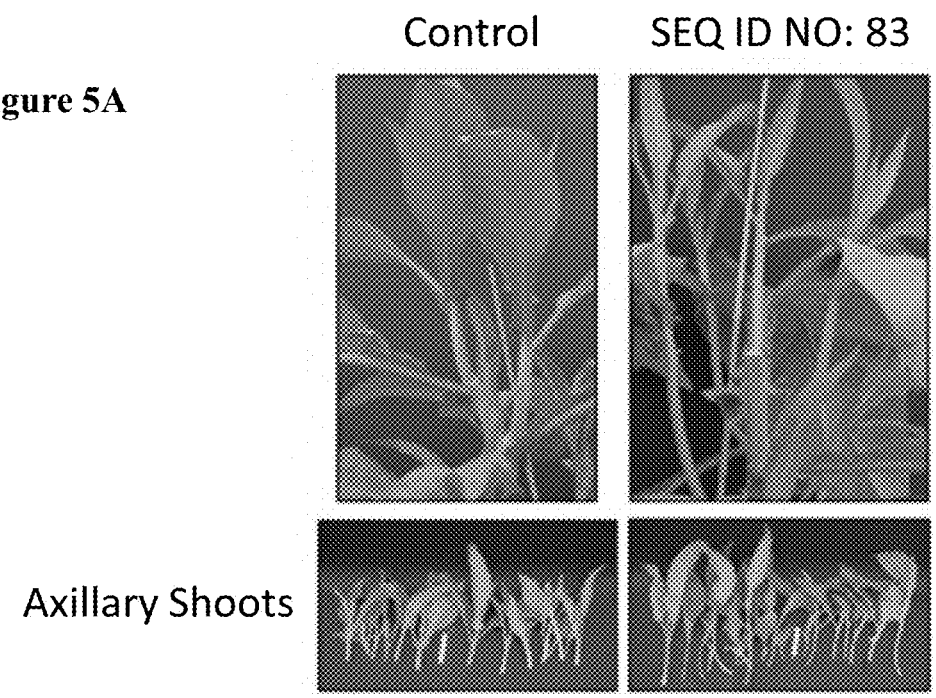
FIG. 5A shows photographs of representative control and modified tobacco plants, as well as all of the axillary shoots from one plant two weeks after topping.
Figure 5B:
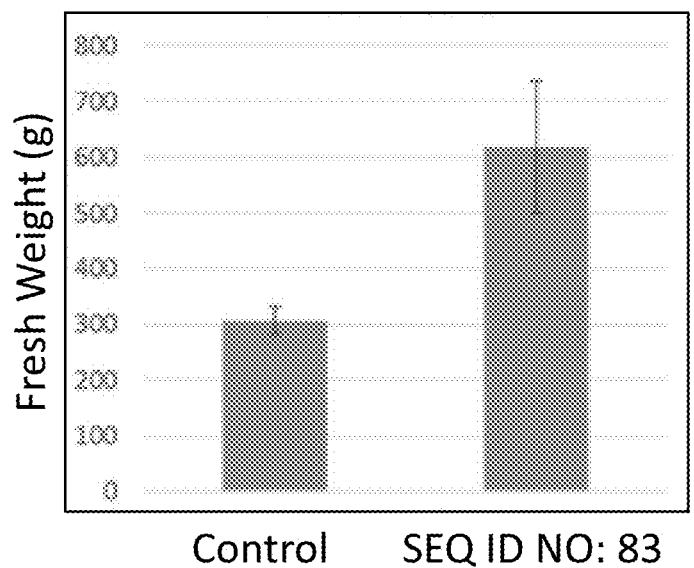
FIG. 5B is a graph displaying the total fresh weight of axillary shoots from control and modified plants two weeks after topping. Modified plants exhibit increased axillary shoot mass compared to control plants.

A first transformation vector comprises SEQ ID NO: 83 inserted into a p45-2-7 backbone for constitutive suppression of native SEQ ID NO: 1 via RNAi, and plants comprising this vector are hereinafter referred to as RNAi_1 plants. RNAi_1 tobacco plants (T0 generation) and control tobacco plants are grown to the layby stage, then plants are topped to remove the shoot apical meristem. Sucker growth is evaluated at the time of topping and one week after topping. Bud outgrowth is apparent in RNAi_1 plants prior to topping, and bud outgrowth increases after topping (FIG. 4). RNAi_1 T1 generation plants continue to show increased bud outgrowth (FIGS. 5A and B) at least two weeks after topping. The fresh weight of all axillary shoots two weeks after topping in Ti RNAi_1 plants averages ~600 grams; the fresh weight of all axillary shoots two weeks after topping of control plants is ~300 grams (FIG. 5B). These results indicate SEQ ID NO: 1 functions to inhibit sucker outgrowth in tobacco.

Figure 6:
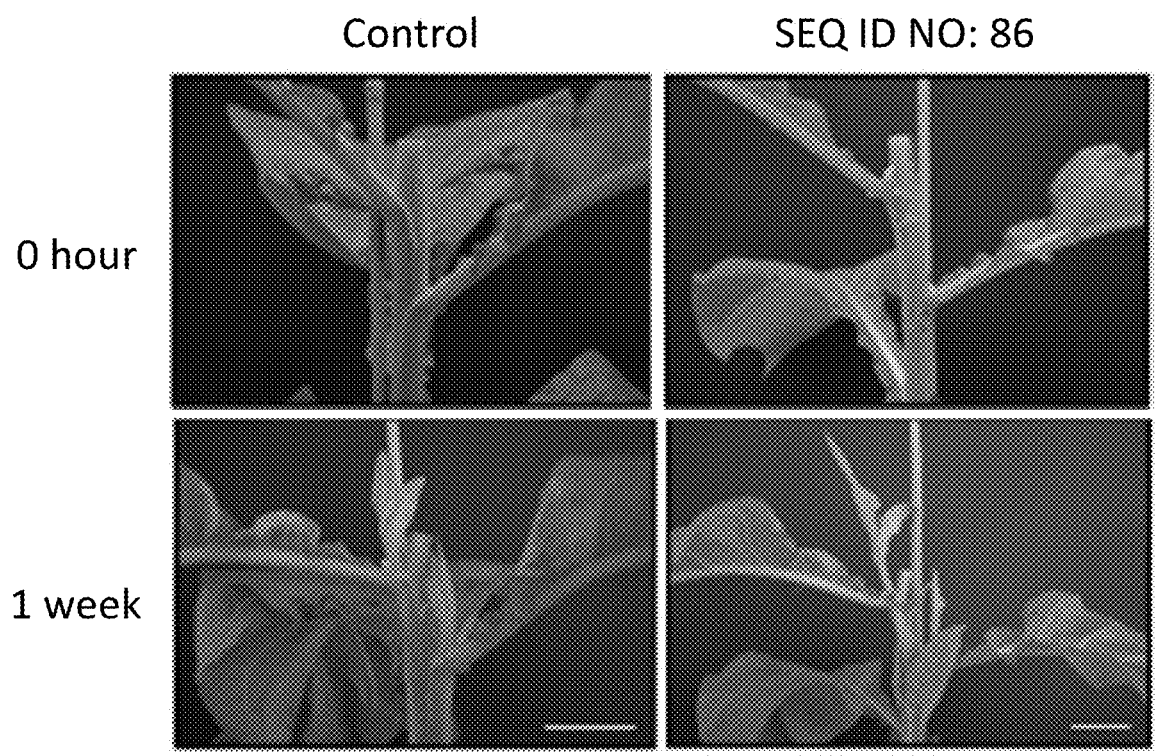
FIG. 6 shows photographs of control tobacco plants and modified tobacco plants that express SEQ ID NO: 86, an RNAi construct that targets SEQ ID NO: 13 for inhibition. Plants are shown at the time of topping (0 hour) and one week after topping. Modified plants exhibit enhanced suckering compared to control plants.
Figure 7:
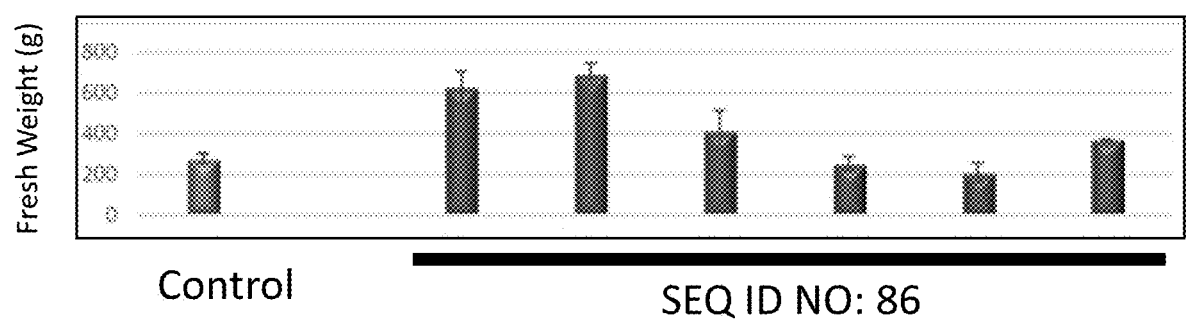
FIG. 7 is a graph displaying the total fresh weight of axillary shoots from control plants and modified tobacco plants that express SEQ ID NO: 86, an RNAi construct that targets SEQ ID NO: 13 for inhibition, two weeks after topping. Data from six independent modified tobacco lines are shown. Modified plants exhibit increased sucker mass compared to control plants.

A second transformation vector comprises SEQ ID NO: 86 inserted into a p45-2-7 backbone. This second transformation vector is designed to repress native SEQ ID NO: 13 via RNAi mechanisms, and plants comprising this vector are hereinafter referred to as RNAi_7 plants. RNAi_7 tobacco plants (T0 generation) and control tobacco plants are grown to the layby stage, then plants are topped to remove the shoot apical meristem. Sucker growth is evaluated at the time of topping and one week after topping. Bud outgrowth increases in RNAi_7 plants (FIG. 6). T1 generation RNAi_7 plants continue to show increased bud outgrowth (FIG. 7) at least two weeks after topping. The fresh weight of all axillary shoots two weeks after topping in seven T1 RNAi_7 plant lines average ~600 grams, ~700 grams, ~400 grams, ~250 grams, ~200 grams, and ~375 grams; the fresh weight of all axillary shoots two weeks after topping of control plants is ~300 grams (FIG. 7). These results indicate SEQ ID NO: 13 functions to inhibit sucker outgrowth in tobacco.

Figure 8:
FIG. 8 shows photographs of modified tobacco plants that express SEQ ID NO: 95, an RNAi construct that targets SEQ ID NO: 35 for inhibition. Modified tobacco plants exhibit sucker outgrowth prior to topping. Arrows point to suckers.
Figure 8:
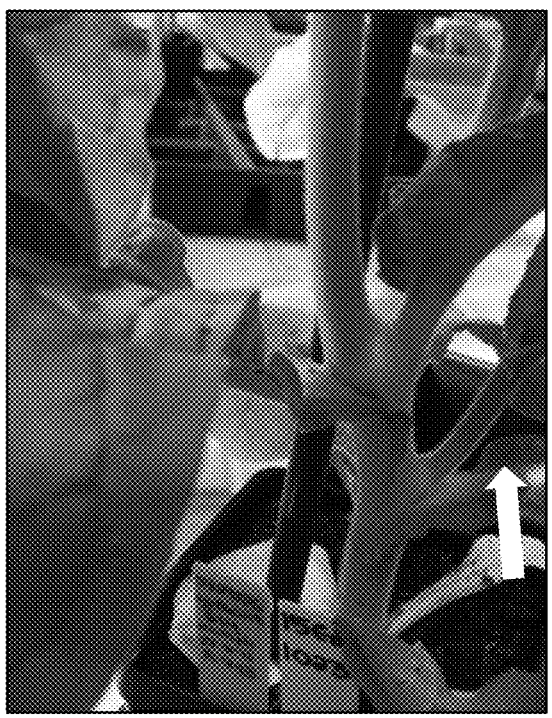

A third transformation vector comprises SEQ ID NO: 95 inserted into a p45-2-7 backbone. This third transformation vector is designed to repress native SEQ ID NO: 35 via RNAi mechanisms, and plants comprising this vector are hereinafter referred to as RNAi_18 plants. RNAi_18 plants develop axillary branches at every node prior to topping (FIG. 8). These results indicate SEQ ID NO: 35 functions to inhibit sucker outgrowth in tobacco.

Example 6. Identification of Native Tobacco Genes that Promote Sucker Growth

Some tobacco genes natively function to promote sucker outgrowth. Inhibiting these genes using RNAi constructs decreases sucker outgrowth and positively identifies the genes as promoters of sucker outgrowth in tobacco. Transformation vectors designed to inhibit predicted promoters of sucker outgrowth via RNAi mechanisms are created according to Example 2; modified tobacco plants comprising the transformation vectors are created and phenotypically evaluated according to Example 2.

A transformation vector is created to comprise SEQ ID NO: 101 in a p45-2-7 backbone, which is homologous to a region of CET2, a CENTRORADIALIS (CEN)-like gene from Tobacco (SEQ ID NOs: 108-110). CET genes are not expressed in the shoot apical meristem in tobacco, although CEN is required for shoot apical meristem growth in *Antirrhinum majus*. In tobacco, expression of CEN extends the vegetative phase and delays flowering. See, for example, Amaya et al., 1999, *Plant Cell* 11:1405-1418, which is herein incorporated by reference in its entirety. Plants comprising a transformation vector comprising SEQ ID NO: 101 are hereinafter referred to as RNAi_NtCET2 plants.

Figure 9:
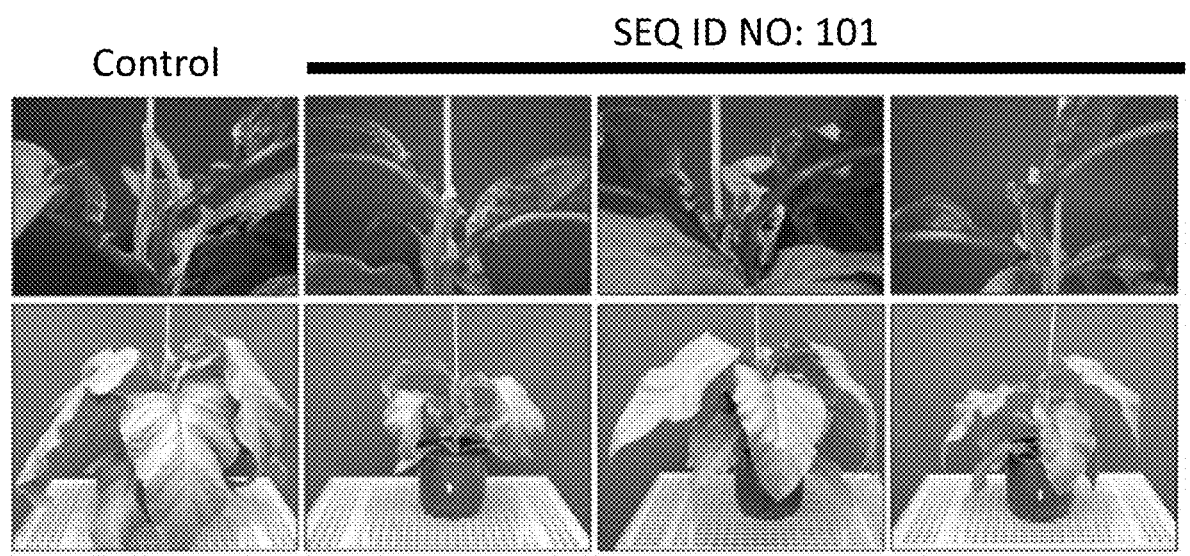
FIG. 9 shows photographs of control tobacco plants and three independent lines of modified tobacco plants that express SEQ ID NO: 101, an RNAi construct that targets tobacco CENTRORADIALIS (SEQ ID NOs: 108-110). Photographs show the apex of a plant (top panel) or an entire plant (lower panel) one week after topping. Sucker growth is reduced in modified plants.

RNAi_NtCET2 plants (T0 generation), and control tobacco plants are grown to the layby stage, then plants are topped to remove the shoot apical meristem. Sucker growth is evaluated at the time of topping and one week after topping. Bud outgrowth is reduced in RNAi_NtCET2 plants (FIG. 9), indicating that native NtCET2 promotes sucker outgrowth.

Figure 10:
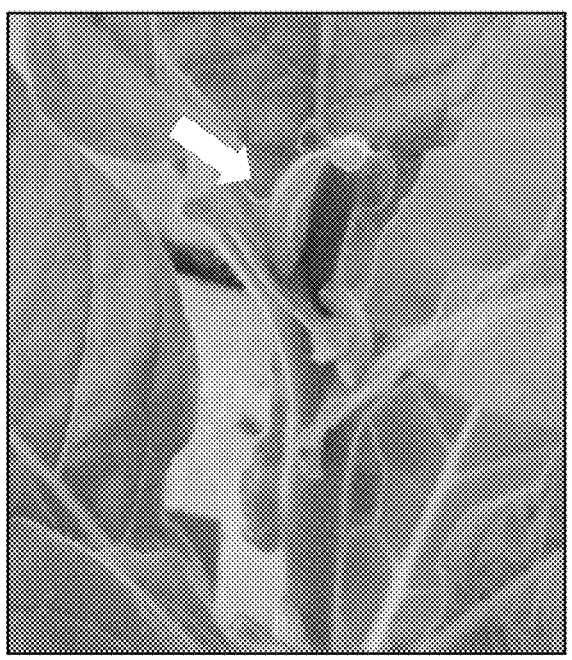
FIG. 10 shows photographs of a control tobacco plant and a modified tobacco plant that expresses SEQ ID NO: 96, an RNAi construct that targets SEQ ID NO: 49 for inhibition. Modified tobacco plants exhibit reduced sucker growth (arrows) compared to control tobacco plants.
Figure 10:
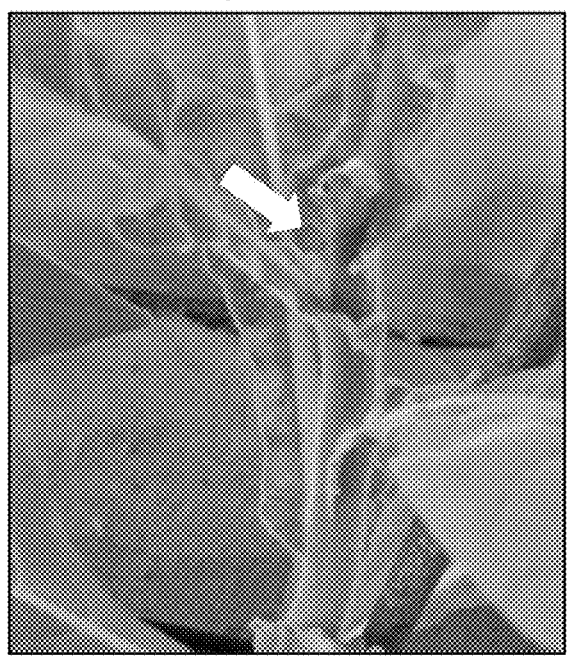

Another transformation vector comprises SEQ ID NO: 96, and plants comprising this vector are hereinafter referred to as RNAi_26 plants. RNAi_26 plants (T0 generation) and control tobacco plants are grown to the layby stage, then plants are topped to remove the shoot apical meristem. Sucker growth is evaluated at the time of topping and one week after topping. Bud outgrowth decreases in RNAi_26 plants (FIG. 10), indicating that SEQ ID NO: 49 natively functions to promote sucker outgrowth.

Example 7. Identification of Axillary Bud-Specific Promoters

Expression of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 67, 69, 79, 81, and 83-107 (See Examples 6-8) can be better utilized to reduce or eliminate sucker outgrowth in modified plants if the polynucleotides are expressed in a tissue-dependent manner (e.g., only in the axillary bud). The expression pattern of 28 candidate genes is analyzed, and promoters of the genes having high expression in axillary buds, but low expression in other tissues, are selected (Table 3). Expression patterns of the candidate genes are confirmed by real-time PCR analysis. Six axillary meristem-specific promoters (SEQ ID NOs: 113-118) are cloned by PCR methods from tobacco TN90 genomic DNA using gene-specific primers.

Expression patterns of candidate promoters are analyzed by transformation of tobacco with a chimeric candidate promoter:beta-glucuronidase (GUS) reporter gene within the same plasmid backbone (p45-2-7) described in Example 2. The chimeric gene is introduced via Agrobacterium-mediated transformation into an NLM line. GUS staining is used to identify tissue-specific promoter expression following the method of Crone et al., 2001, *Plant Cell Environ.* 24:869-874.

Briefly, tissue from young seedlings comprising a candidate promoter:GUS transformation construct is placed in cold 90% acetone on ice. When all samples are harvested, samples are placed at room temperature for 20 minutes. Samples are placed back on ice and acetone is removed from the samples. Next, staining buffer (0.2% Triton X-100; 50 mM NaHPO$_4$, pH7.2; 2 mM potassium ferrocyanide) is added to the samples. X-Gluc is added to the staining buffer to a final concentration of 2 mM. Staining buffer is removed from the samples and fresh staining buffer with X-Gluc is added. The samples are then infiltrated under vacuum, on ice, for 15 to 20 minutes. The samples are incubated at 37 degrees Celsius for 2-18 hours before the staining buffer is removed. Samples are washed through an ethanol series (i.e., 10%, 30%, 50%, 70%, 95%) in the dark for 30 minutes per wash. Finally, samples are transferred into 100% ethanol.

Figure 11:
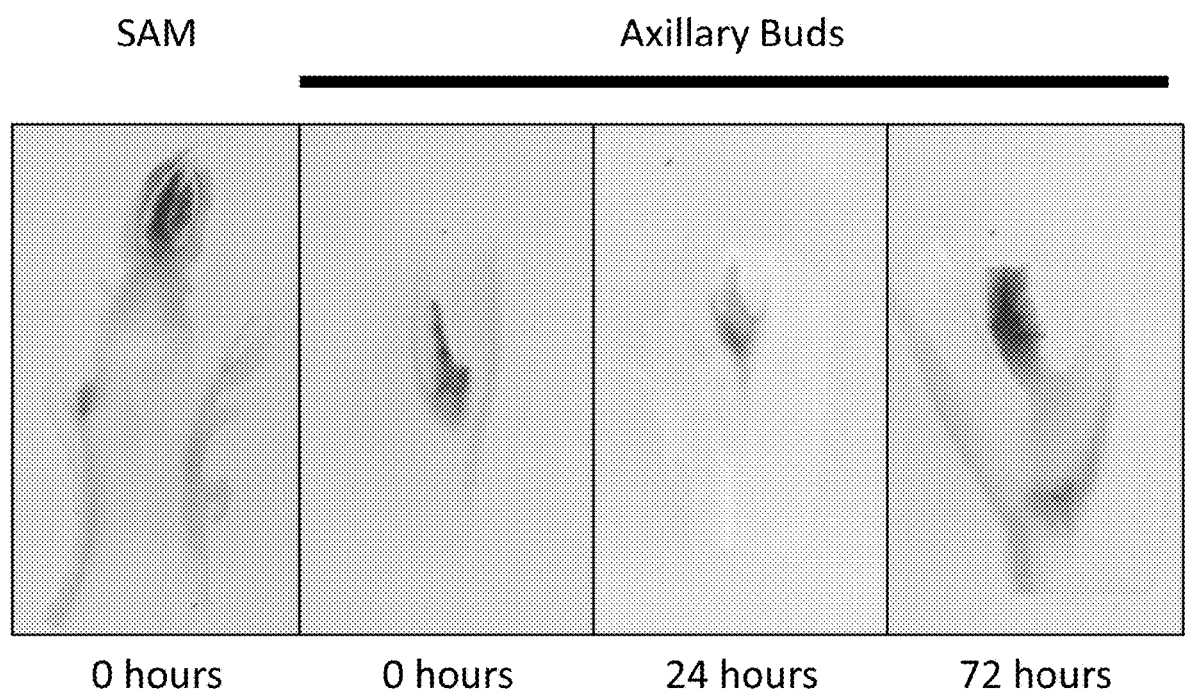
FIG. 11 shows the expression pattern of Promoter P1 (SEQ ID NO: 113) fused to β-glucuronidase (GUS) in a tobacco shoot apical meristem (SAM) at the time of topping (0 hours) and in an axillary bud at 0 hours, 24 hours after topping, and 72 hours after topping. Dark areas of GUS accumulation demonstrate where Promoter P1 is active. Promoter P1 is functional in both shoot apical and axillary buds.
Figure 12:
FIG. 12 shows the expression pattern of Promoter P11 (SEQ ID NO: 116) fused to β-glucuronidase (GUS) in a tobacco seedling; a tobacco seedling shoot apical meristem (SAM); a mature SAM at the time of topping (0 hours); and an axillary bud at the time of topping, 3 days after topping, 5 days after topping, and 7 days after topping. Dark areas of GUS accumulation demonstrate where Promoter P11 is active. Promoter P11 is weakly active in axillary buds prior to topping and has higher activity in axillary buds 3 days after topping. Activity of Promoter P11 decreases by 5 and 7 days after topping. Promoter P11 is also active in the SAM prior to topping. No GUS staining is detected in seedlings.
Figure 12:
Figure 12:
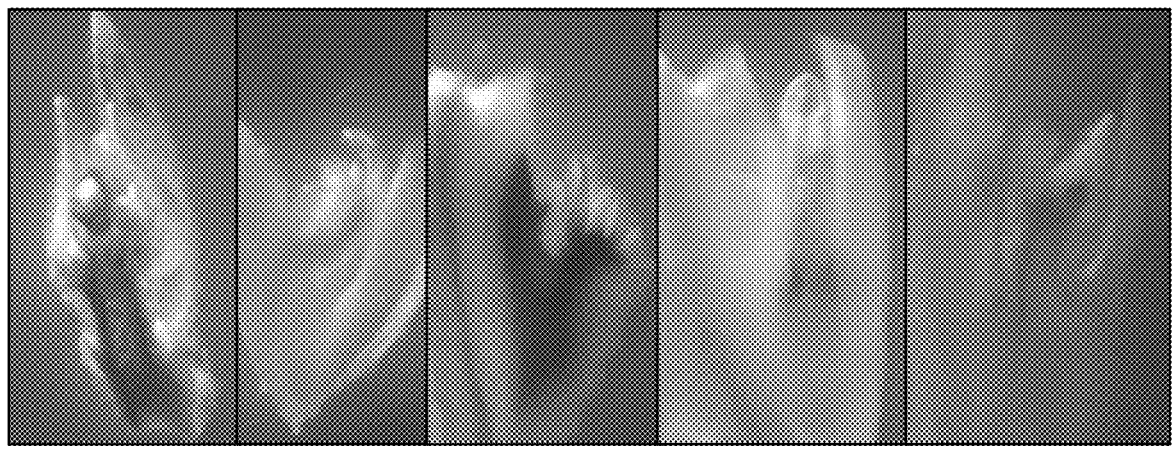

GUS-positive plant tissues are examined with a brightfield microscope (Leica Q500MC; Cambridge, England) at a low magnification and photographed with a digital camera. Results of experiments using three different promoters (SEQ ID NOs: 113, 116, and 117) are shown in FIGS. 11, 12, and 13, respectively. These promoter sequences can be used to drive the expression of a sequence of interest exclusively, or predominantly, within an axillary bud while limiting expression in the rest of the plant.

GUS-positive expression, indicating expression driven by SEQ ID NOs: 113, 116, and 117, is concentrated in axillary buds. Thus, SEQ ID NOs: 113, 116, and 117 are tissue-specific promoters that are active in axillary buds, but not in stem or leaf tissue (FIGS. 11, 12, and 13). The expression of GUS under the direction of SEQ ID NOs: 113 (Promoter P1, hereinafter) and 116 (Promoter P11, hereinafter) decreases after topping, which coincides with the gene expression pattern that is observed for the endogenous genes that are normally regulated by these promoters (FIGS. 11 and 12). Promoter P1 and Promoter P11 are also functional in the tobacco shoot apical meristem. (FIGS. 11 and 12).

Figure 13A:
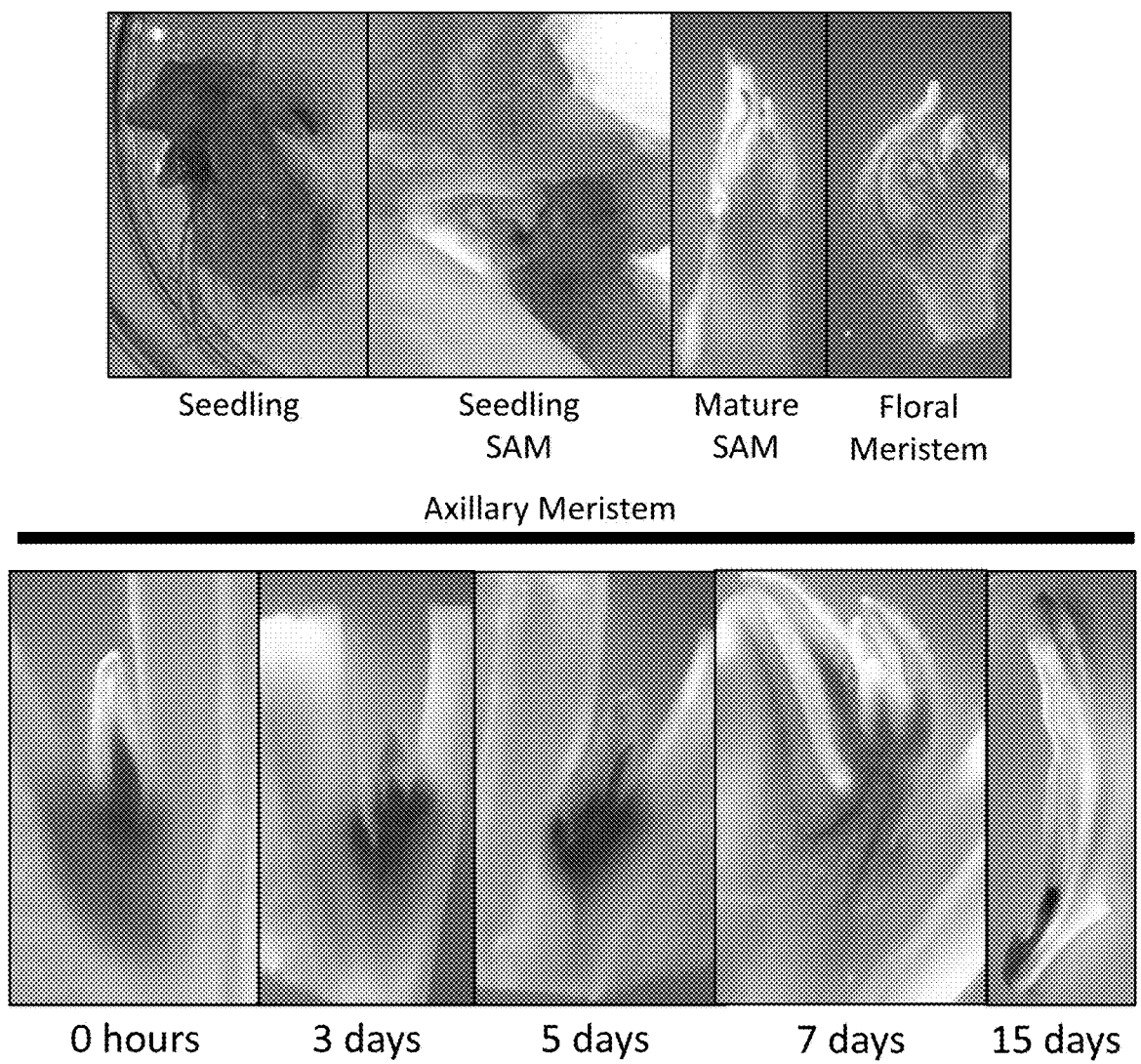
FIG. 13A shows Promoter P15 activity in a tobacco seedling; a tobacco seedling shoot apical meristem (SAM); a mature SAM at the time of topping (0 hours); and an axillary bud at the time of topping, 3 days after topping, 5 days after topping, 7 days after topping, and 15 days after topping. Promoter P15 is not active in seedlings. Promoter P15 is active at the base of the SAM, but it is not active in floral meristems. Promoter P15 exhibits strong activity in axillary buds prior to topping, and the activity is maintained for at least 15 days after topping.
Figure 13B:
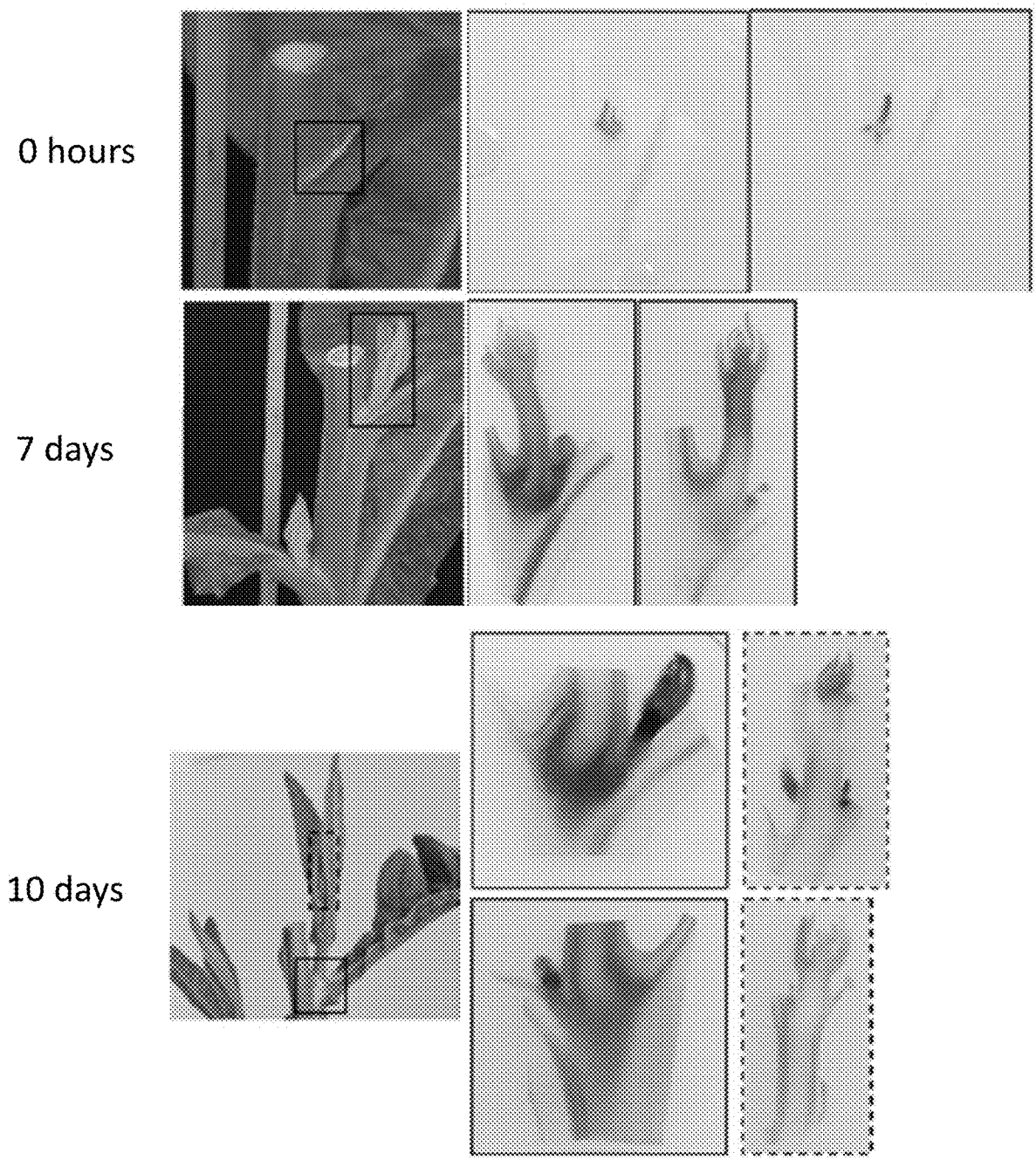
FIG. 13B further demonstrates the axillary bud specificity of Promoter P15.

In contrast, SEQ ID NO: 117 (Promoter P15, hereinafter) drives GUS expression in the axillary meristem prior to topping and for at least fifteen days after topping, which coincides with the gene expression pattern that is observed for the endogenous gene that is normally regulated by this promoter (FIGS. 13A-C). Promoter P15 is also functional in the base of the shoot apical meristem (FIG. 13A).

Additional candidate promoters of topping-inducible, and tissue-specific, promoters to control sucker outgrowth include SEQ ID NOs: 148-160 and 204, which represent an axillary bud-specific thionin 5' upstream regulatory sequence (SEQ ID NO: 148); a tobacco lateral suppressor 1 (LAS1) 5' upstream regulatory sequence (SEQ ID NO: 149); a LAS1 3' downstream regulatory sequence (SEQ ID NO: 150); a LAS2 5' upstream regulatory sequence (SEQ ID NO: 151); a LAS2 3' downstream regulatory sequence (SEQ ID NO: 152); a tobacco regulator of axillary meristems1 (RAX1) 5' upstream regulatory sequence (SEQ ID NO: 153); a RAX1 3' downstream regulatory sequence (SEQ ID NO: 154); a RAX2 5' upstream regulatory sequence (SEQ ID NO: 155); a RAX2 3' downstream regulatory sequence (SEQ ID NO: 156); a Promoter P15 5' region (SEQ ID NO: 157); a Promoter P15 3' downstream region, (SEQ ID NO: 158); a 5' upstream regulatory sequence of a P15 homolog (SEQ ID NO: 159); a 3' downstream regulatory sequence of a P15 homolog (SEQ ID NO: 160); and a regulatory region of a P15 homolog from tomato (*Solanum lycopersicum*) (SEQ ID NO: 204). The sequences are cloned by PCR methods from NLM genomic DNA using gene-specific primers. These regulatory sequences are tested for their tissue specificity and developmental regulation as shown for Promoters P1, P11, and P15. The regulatory sequences that exhibit axillary meristem-specific or -preferential expression are used for driving heterologous gene expression and modulating sucker growth.

TABLE 3

Selected clones for promoter analysis

| SEQ ID NO | Length of Promoter |
| --- | --- |
| 113 | 2248 |
| 114 | 2800 |
| 115 | 3356 |
| 116 | 3150 |
| 117 | 2964 |
| 118 | 941 |
| 148 | 5000 |
| 149 | 5000 |
| 150 | 5000 |
| 151 | 5000 |
| 152 | 5000 |
| 153 | 5000 |
| 154 | 5000 |
| 155 | 5000 |
| 156 | 5000 |
| 157 | 5000 |
| 158 | 5000 |
| 159 | 5000 |
| 160 | 5000 |
| 204 | 5000 |

TABLE 4

Axillary bud-preferred promoter cis-elements

| Cis-regulatory element Name | Cis-regulatory element Nucleotide Sequence |
| --- | --- |
| Bud Dormancy Element (BDE) | CACGTG |
| Axillary Bud Growth (Up1) | GGCCCAW |
| Axillary Bud Growth (Up2) | AAACCCTA |
| Sucrose Responsive Element (SURE) | AATAGAAAA |
| Sugar Repressive Element (SRE) | TTATCC |
| Bud Activation Element or TCP Binding Element (BAE) | GGCCCAT |

Figure 14A:
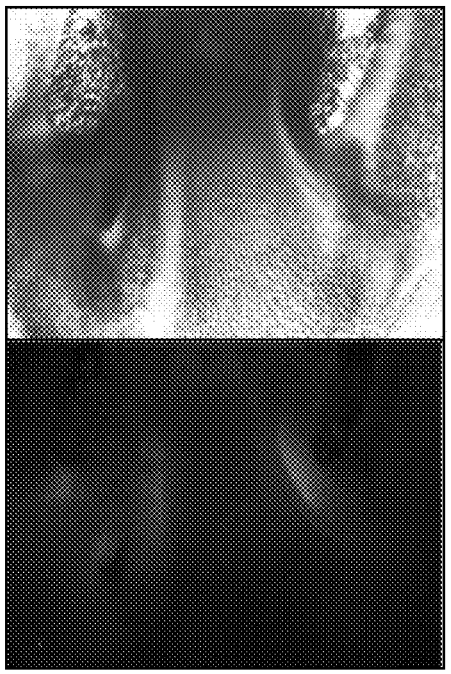
FIG. 14A shows results of a Promoter P15 (SEQ ID NO: 117):GFP fusion in a shoot apical meristem (SAM) and axillary bud (left panel) and in an axillary bud (right panel). Promoter P15 activity is restricted to axillary buds.
Figure 14A:
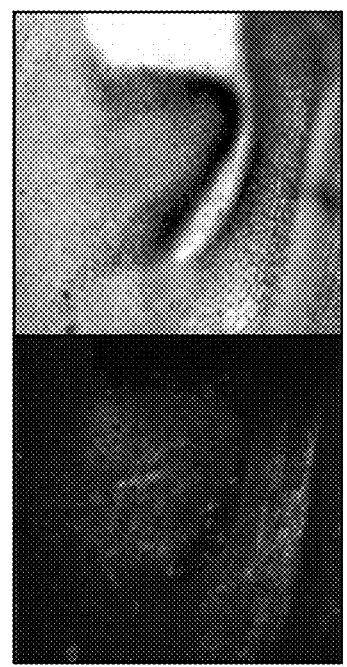
Figure 14B:
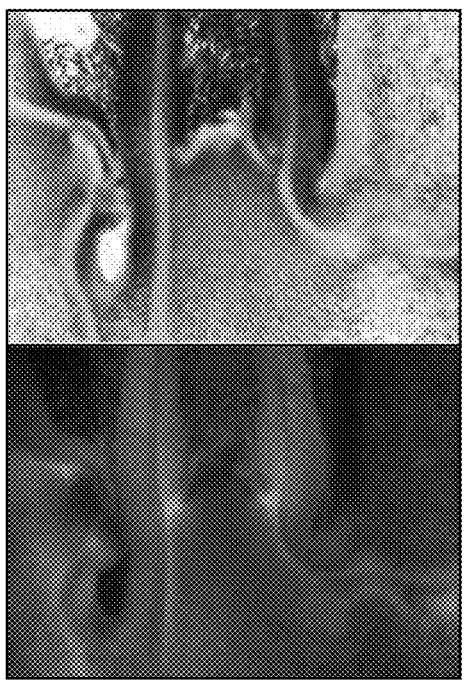
FIG. 14B shows results of a Promoter P1 (SEQ ID NO: 113):GFP fusion in a shoot apical meristem (SAM) and axillary bud (left panel) and in an axillary bud (right panel).
Figure 14B:

Example 8. Cellular Specificity of Promoter P1, Promoter P15, and Promoter PAB Thionin To analyze the expression pattern of Promoter P1 (SEQ ID NO: 113) and Promoter P15 (SEQ ID NO: 117) at the cellular level in meristem regions, vectors are produced comprising a green fluorescent protein (GFP) gene under the control of either Promoter P1 or Promoter P15 as described in Example 2. The chimeric vectors are introduced into an NLM tobacco plant via *Agrobacterium*-mediated transformation. GFP expression is observed using fluorescence microscopy. Promoter P15 is restricted to tissue within the axillary buds (FIG. 14A). Promoter P1 has a slightly broader expression pattern (FIG. 14B).

Figure 15:
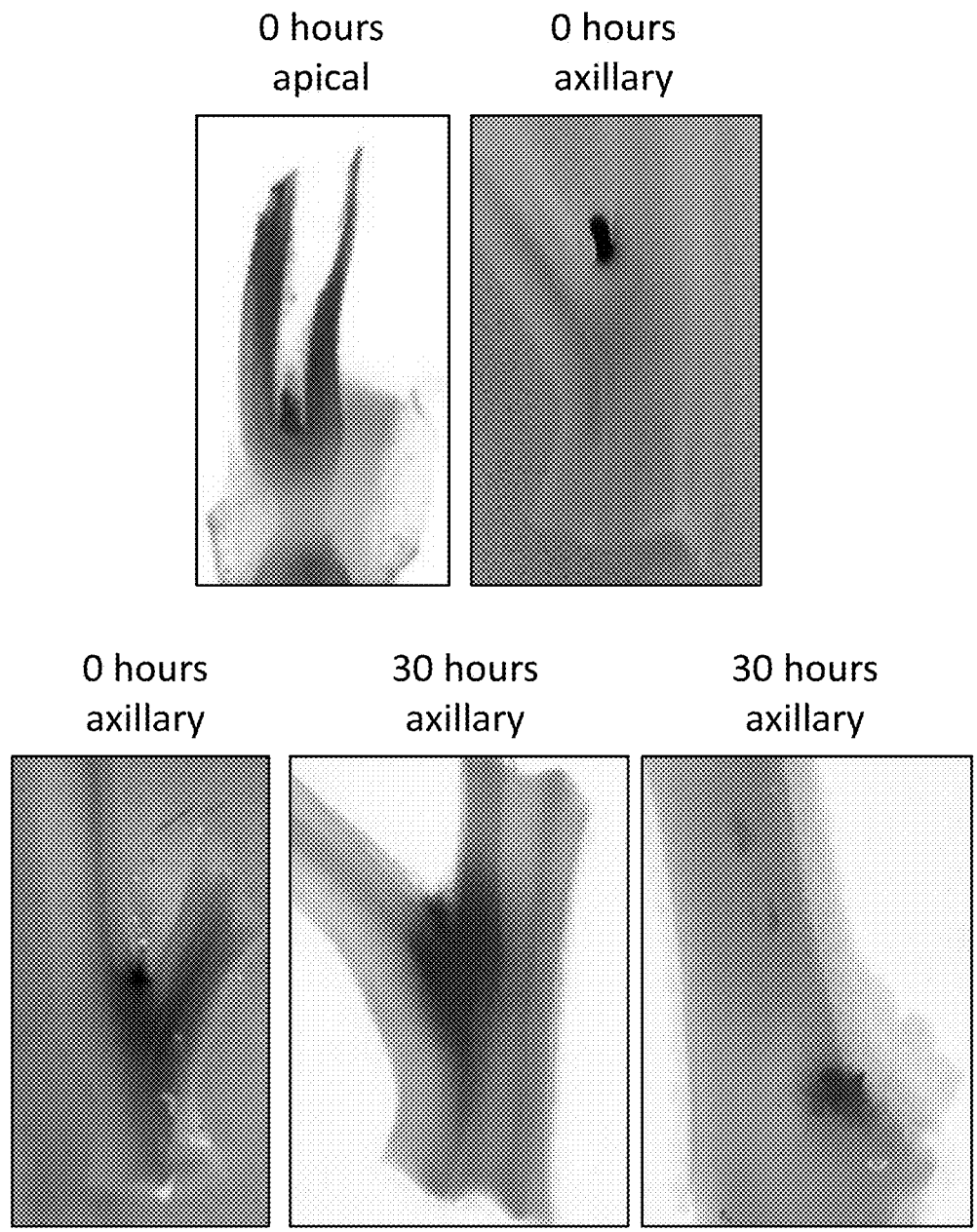
FIG. 15 shows the expression pattern of an axillary bud Thionin promoter (pABTh, SEQ ID NO: 118) fused to β-glucuronidase (GUS) in tobacco apical and axillary meristems at the time of topping (0 hours) and 30 hours after topping. Dark areas of GUS accumulation demonstrate where Promoter P15 is active.

To analyze the expression pattern of a 0.9 kb long Promoter PAB Thionin (pABTh-0.9 kb, SEQ ID NO: 118) at the cellular level in meristem regions, a vector is produced comprising a GUS gene under the control of Promoter PAB Thionin as described in Example 2. The chimeric vector is introduced into an NLM tobacco plant via *Agrobacterium*-mediated transformation. GUS expression is observed in axillary bud tissue and meristem tissue (FIG. 15).

Figure 16:
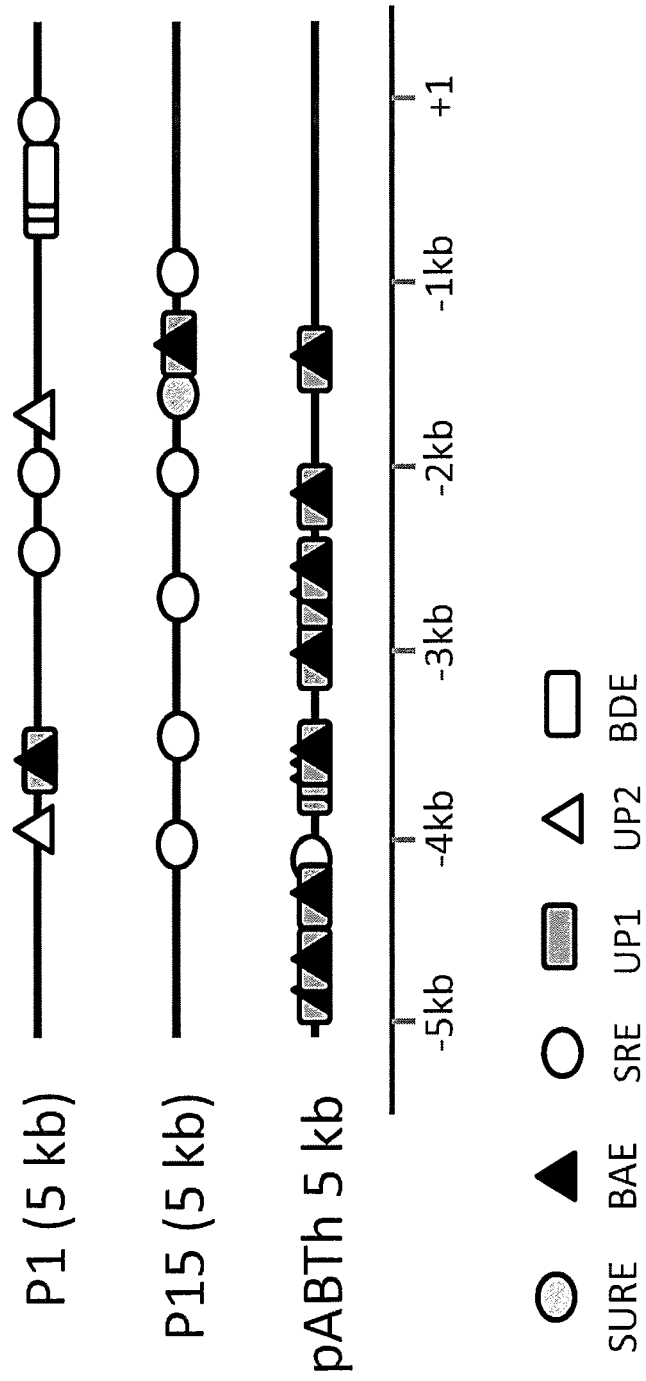
FIG. 16 shows the locations of cis-regulatory elements in Promoter P1 (SEQ ID NO: 113), Promoter P15 (SEQ ID NO: 117), and Promoter pABTh (SEQ ID NO: 118). +1 designates the transcriptional start site.

Promoters P1, P15, and PAB Thionin (pABth-5 kb, SEQ ID NO: 148) are analyzed for similar and/or unique cis-regulatory elements. Six cis-regulatory elements are identified (Table 4) upstream of the transcriptional start sites of the genes natively regulated by Promoters P1, P15, and PAB Thionin (FIG. 16). These cis-regulatory elements can have direct and/or indirect effects towards regulating sucker-specific or meristem-specific expression patterns.

Example 9. Efficacy Testing of Sucker Inhibiting Constructs

After testing of the tissue-specific expression patterns of candidate promoters using promoter:GUS fusion analysis in transgenic plants, vectors and modified plants are constructed as described in Example 2 to express target genes only in axillary buds. Exemplary constructs are shown in Table 5.

TABLE 5

Exemplary constructs for axillary bud-specific expression of a target gene.

| Construct | Promoter SEQ ID NO. | Target Gene SEQ ID NO. |
| --- | --- | --- |
| 1 | 113 | 17 |
| 2 | 113 | 104 |
| 3 | 113 | 7 |
| 4 | 113 | 41 |
| 5 | 113 | 5 |
| 6 | 118 | 17 |
| 7 | 118 | 104 |
| 8 | 118 | 7 |
| 9 | 118 | 41 |
| 10 | 118 | 5 |
| 11 | 115 | 17 |
| 12 | 115 | 104 |
| 13 | 115 | 7 |
| 14 | 115 | 41 |
| 15 | 115 | 5 |
| 16 | 117 | 17 |
| 17 | 117 | 104 |
| 18 | 117 | 7 |
| 19 | 117 | 41 |
| 20 | 117 | 5 |

Efficacy testing for the impact of Constructs 1-20 is carried out under greenhouse and field conditions. Transgenic plants and matched wild type controls are grown to layby stage, then topped and phenotypically evaluated as described in Example 2. Field efficacy testing also determines the type and extent of sucker control chemical application needed under normal agronomical practices.

Example 10. Regulating Axillary Bud Outgrowth Via Overexpressing Genes

Sucker outgrowth can be regulated by modifying the expression of genes and/or genetic pathways that regulate branching. Some genes natively function to restrict bud outgrowth and are defined by mutants with increased branching, for example the *Arabidopsis* BRANCHED1 gene (SEQ ID NO:81) and tobacco homologs (SEQ ID NOs: 1, 13, 35, 37, and 39); and the *Arabidopsis* MORE AXILLARY BRANCHING1 (MAX1) and MAX2 genes (SEQ ID NO: 193 and 195) and tobacco homologs (SEQ ID NO: 197 and 199). See, for example, Stirnberg et al., 2002, *Development* 129: 1131-1141, which is herein incorporated by reference in its entirety.

Transformation vectors are created to overexpress proteins that restrict sucker outgrowth in tobacco. Separate transformation vectors comprising one of SEQ ID NOs: 1, 13, 35, 37, 39, and 81 are incorporated into p45-2-7 transformation vectors. Additional transformation vectors are created comprising one of SEQ ID NOs: 1, 13, 35, 37, 39, and 81 driven by the axillary bud-specific Promoter P15 (SEQ ID NO: 117). Modified tobacco plants are generated from these transformation vectors according to Example 2. Modified tobacco plants (T0 generation) and control tobacco plants are then phenotypically evaluated as described in Example 2. The modified tobacco plants exhibit reduced sucker growth compared to control tobacco plants.

Example 11. Regulating Axillary Bud Outgrowth by Suppressing Genes that Promote Sucker Growth Some genes promote axillary meristem development and are defined by mutants with decreased branching. For example, the *Arabidopsis* LAS gene (SEQ ID NO: 201), and homologs in tobacco (SEQ ID NOs: 71 and 73); and the *Arabidopsis* RAX gene (SEQ ID NO: 203), as well as tobacco homologs (SEQ ID NOs: 75 and 77). See, for example, Greb et al., 2003, *Genes & Development* 17: 1175-1187; and Keller et al., 2006, Plant Cell 18: 598-611, both of which are herein incorporated by reference in their entireties.

Transformation vectors comprising RNAi constructs are designed to inhibit tobacco proteins that promote sucker outgrowth. Separate transformation vectors comprise one of SEQ ID NOs: 71, 73, 75, and 77, which are incorporated into p45-2-7 transformation vectors. Additional transformation vectors are created comprising one of SEQ ID NOs: 71, 73, 75, and 77 driven by axillary bud-specific Promoter P15 (SEQ ID NO: 117). These vectors are used to generate modified tobacco plants according to Example 2. Modified tobacco plants and control tobacco plants are then phenotypically evaluated as described in Example 2. The modified tobacco plants exhibit reduced sucker growth compared to control tobacco plants.

Example 12. Regulating Sucker Growth with RNAi, Artificial miRNAs and Gene Overexpression A transformation vector is created in which Promoter P15 (SEQ ID NO: 117) drives the expression of SEQ ID NOs: 81

(BRC1) and 101 (RNAi targeting NtCET2) in a tissue-specific manner. The Promoter P15:BRC1:NtCET2 vector over-expresses BRC1 and inhibits NtCET2 in axillary buds. The transformation vector and modified tobacco plants are generated as described in Example 2.

Figure 17:
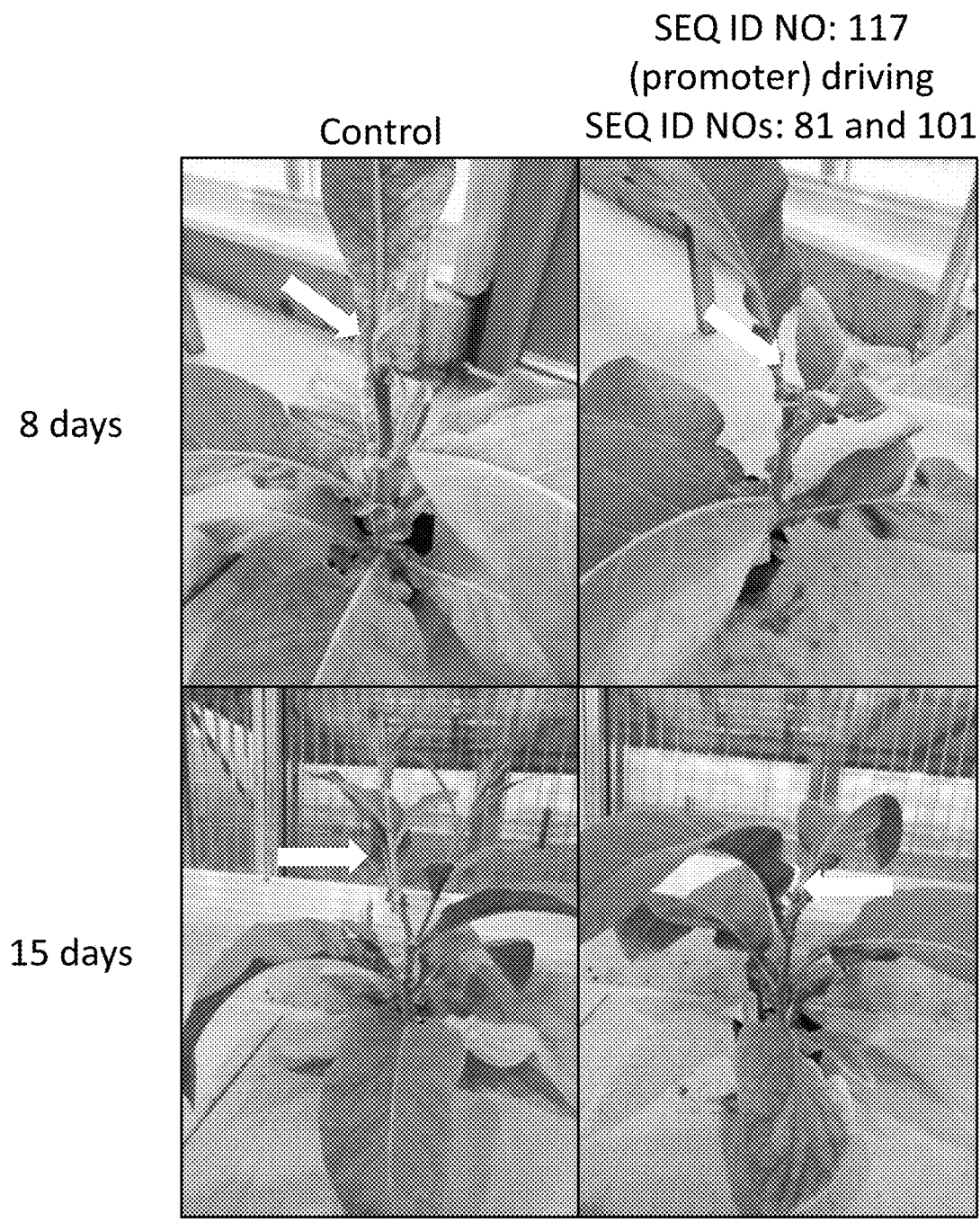
FIG. 17 shows photographs of control tobacco plants and modified tobacco plants that express SEQ ID NO: 81, which encodes *Arabidopsis thaliana* BRANCHED1 and inhibits sucker growth, and SEQ ID NO: 101, an RNAi construct that targets tobacco CENTRORADIALIS and reduces sucker growth, driven by axillary bud-specific Promoter P15 (SEQ ID NO: 117). Plants are shown 8 days after topping and 15 days after topping. Modified plants exhibit reduced sucker growth (arrows) compared to control plants.

Modified tobacco plants (T0 generation) having a Promoter P15:BRC1:NtCET2 construct and control tobacco plants are grown to the layby stage, then plants are topped to remove the shoot apical meristem. Sucker growth is evaluated at the time of topping, 8 days after topping, and 15 days after topping (FIG. 17). Expression of SEQ ID NOs: 81 and 101, driven by Promoter P15, eliminates sucker growth in tobacco.

Additional transformation vectors are created in which Promoter P15 (SEQ ID NO: 117) drives the expression of an artificial miRNA designed to reduce the transcription or translation of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 69, 71, 73, 75, 77, 123-147, 186, 188, 190, 196, and 198. The transformation vectors and modified tobacco plants are generated as described in Example 2.

Modified tobacco plants (T0 generation) having a Promoter P15:artificial miRNA construct and control tobacco plants are grown to the layby stage, then plants are topped to remove the shoot apical meristem. Modified and control tobacco plants are phenotypically evaluated according to Example 2.

Example 13. Regulating Sucker Growth Via Modifying Cytokinin Synthesis and Distribution Removing the shoot apical meristem releases axillary buds from dormancy and promotes sucker outgrowth. Auxin derived from an intact shoot apical meristem suppresses sucker outgrowth, whereas cytokinin induced by removal of the shoot apical meristem promotes sucker outgrowth.

Figure 18:
FIG. 18 shows photographs of control plants and a modified tobacco plant that expresses SEQ ID NO: 59 (*Nicotiana tabacum* cytokinin oxidase 13) under the control of Promoter P15 (SEQ ID NO: 117) eight days after topping. Modified plants exhibit reduced sucker growth (arrows) compared to control plants.
Figure 18:
Figure 18:
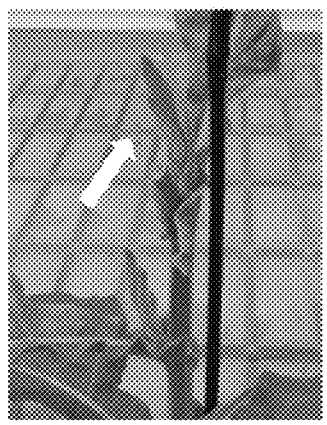
Figure 18:

Depletion of cytokinin in axillary bud regions by overexpressing genes involved in cytokinin catabolism with an axillary bud specific promoter is used to reduce cytokinin and inhibit axillary meristem outgrowth. For example, *Arabidopsis* cytokinin oxidase (CKX; SEQ ID NO: 55), tobacco CKXs (SEQ ID NOs: 57 and 59); and a tobacco adenosine phosphate-isopentenyltransferase gene (SEQ ID NO: 61) are tested. A transformation vector comprising SEQ ID NO: 59 driven by Promoter P15 (SEQ ID NO: 117) is created according to Example 2. Modified tobacco plants are generated using this vector, and then phenotypically evaluated, according to Example 2. The modified tobacco plants exhibit reduced sucker growth compared to control tobacco plants (FIG. 18).

Example 14. Regulating Sucker Growth Via Inhibition of Axillary Meristem Stem Cell Signaling Shoot meristems comprise stem cells that are continuously replenished through a feedback circuit involving the WUSCHEL (WUS)-CLAVATA (CLV) signaling pathway. See, for example, Yadav et al., 2011, *Genes & Development* 25:2025-2030, which is herein incorporated by reference in its entirety. Genes from this pathway include, e.g., WUS (SEQ ID NOs: 63 and 65); CLV1; CLV2; and CLV3 (SEQ ID NOs: 67 and 69). A transformation vector is created comprising SEQ ID NO: 67 driven by Promoter P15 (SEQ ID NO: 117), which causes overexpression of CLV3 in axillary buds. Modified tobacco plants are generated using this transformation vector, and phenotypically evaluated, according to Example 2. The modified tobacco plants exhibit reduced sucker growth compared to control tobacco plants.

Additional transformation vectors are created according to Example 2 to comprise either SEQ ID NO: 63 or 65 driven by Promoter P15 (SEQ ID NO: 117), which inhibit WUS via RNAi. Modified tobacco plants are generated using these transformation vectors, and then phenotypically evaluated, according to Example 2. The modified tobacco plants exhibit reduced sucker growth compared to control tobacco plants.

*Arabidopsis* SHOOT MERISTEMLESS (STM) is a KNOX protein that is essential for shoot meristem formation and maintenance. See, for example, Long et al., 1996, *Nature* 379:66-69, which is herein incorporated by reference in its entirety. NTH15 (SEQ ID NO: 189) is a tobacco homolog of STM that is expressed in tobacco meristems. See, for example, Tanaka-Ueguchi et al., 1998, *Plant Journal* 15:391-400, which is herein incorporated by references in its entirety. A transformation vector is created comprising an RNAi construct that targets SEQ ID NO: 188 for inhibition, driven by Promoter P15 (SEQ ID NO: 117). Modified tobacco plants are generated using these transformation vectors, and then phenotypically evaluated, according to Example 2. The modified tobacco plants exhibit reduced sucker growth compared to control tobacco plants.

Example 15. Screening for Genes to Control Suckers Using Agroinfiltration

Expression of some plant genes (without being limiting, e.g., RNases; proteases; cell cycle genes; transcription factors; kinases; caspases) can elicit a cell death response when expressed at certain times and/or cell types. Identification of such genes is desired, as they can be operably linked to an axillary bud-preferred or axillary bud-specific promoter (e.g., Promoter P15/SEQ ID NO: 117) to reduce or eliminate axillary bud growth and/or development.

Figure 21:
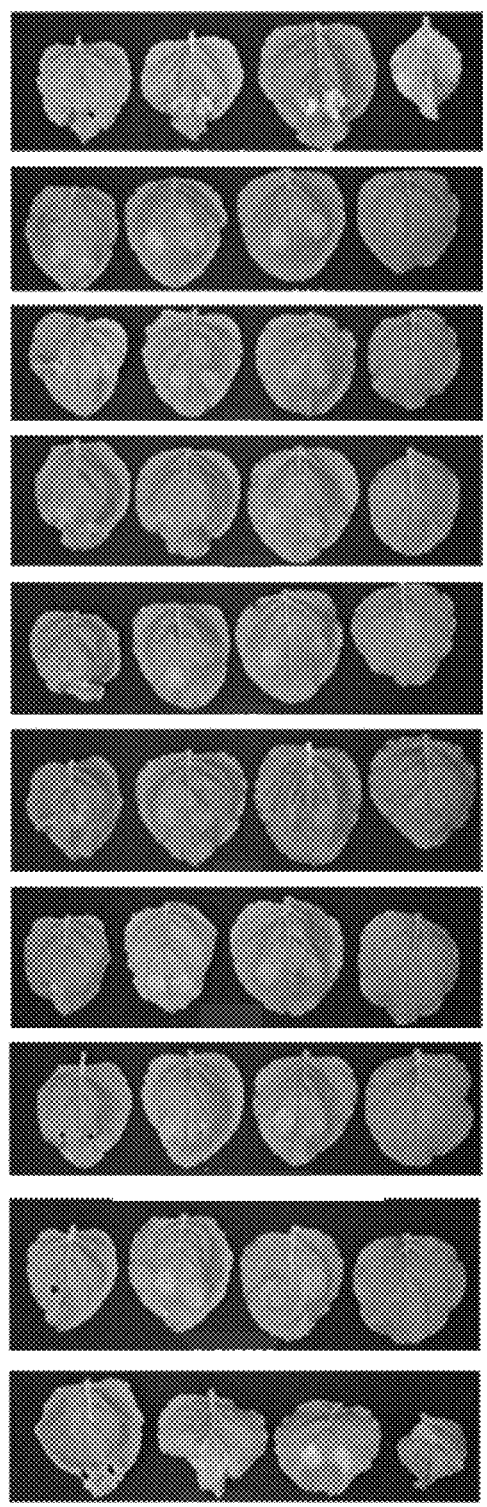
FIG. 21 shows photographs of tobacco leaves subjected to agroinfiltration as described in Example 15. A vector expressing SEQ ID NO: 79 (Barnase) is used as a positive control, and an vector lacking an insert (empty vector) is used as a negative control. Genes of interest are examined ability to induce cellular death in a tobacco leaf according to Example 15. For example, SEQ ID NO: 232 causes cellular death when expressed in a tobacco leaf.

Agroinfiltration is used to transiently express a tobacco genes (e.g., SEQ ID NOs: 201-222, 228, 230, and 232) in tobacco leaves. Plant genes of interest are inserted into a pBIN19 plasmid and transformed into *Agrobacterium tumefaciens* cells. The transformed bacteria are grown in a liquid culture, washed, and suspended in a buffer solution. The buffer solution containing the transformed *A. tumefaciens* cells is injected into one or more living tobacco leaves. Plant leaf phenotypes are then evaluated for presence or absence of cellular death after 5 days. An empty plasmid is used as a negative control, while a plasmid containing a Barnase gene (SEQ ID NO: 79) is used as a positive control. Plant genes inducing cell death in tobacco leaves are used for reducing axillary bud growth and/or development. See, for example, FIG. 21.

*Nicotiana thaliana* mitogen-activated protein kinase kinase 2 (NtMEK2; SEQ ID NO: 232) has been identified as being capable of inducing a cell death response in tobacco. The expression of SEQ ID NO: 232 is directed to axillary buds by driving its expression with Promoter P15 (SEQ ID NO: 117).

Separate transformation vectors are created according to Example 2 to comprise one of SEQ ID NOs: 201-222, 228, 230, and 232 driven by Promoter P15 (SEQ ID NO: 117). Modified tobacco plants are then generated with the Promoter P15:cell death gene vectors, and then phenotypically evaluated, according to Example 2. The modified tobacco plants exhibit reduced sucker growth compared to control tobacco plants.

Example 16. Regulating Sucker Growth Using RNases

The presence of some proteins at elevated levels, in cells where they are not normally expressed, or in subcellular locations where they are not normally located, can induce cell death. Axillary bud specific promoters, such as Promoter P1 (SEQ ID NO: 113) and Promoter P15 (SEQ ID NO: 117) are used to the express heterologous genes that are detrimental to an axillary bud and ultimately result in its death.

Figure 19:
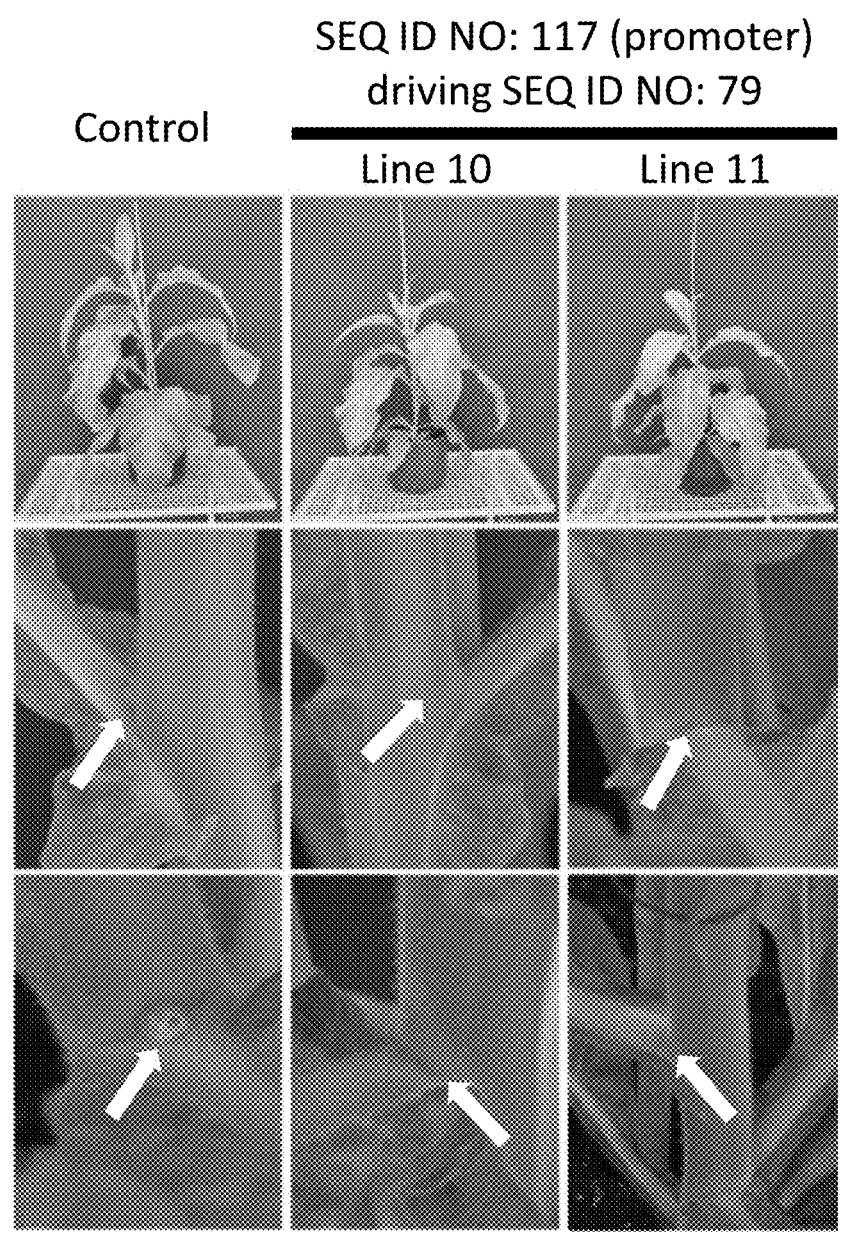
FIG. 19 shows photographs of control plants and two independent lines of modified tobacco plants that express SEQ ID NO: 79 (Barnase) under the control of Promoter P15 (SEQ ID NO: 117). Modified plants exhibit reduced sucker growth (arrows) compared to control plants. No axillary meristem primordia are observed before topping the modified plants.
Figure 20A:
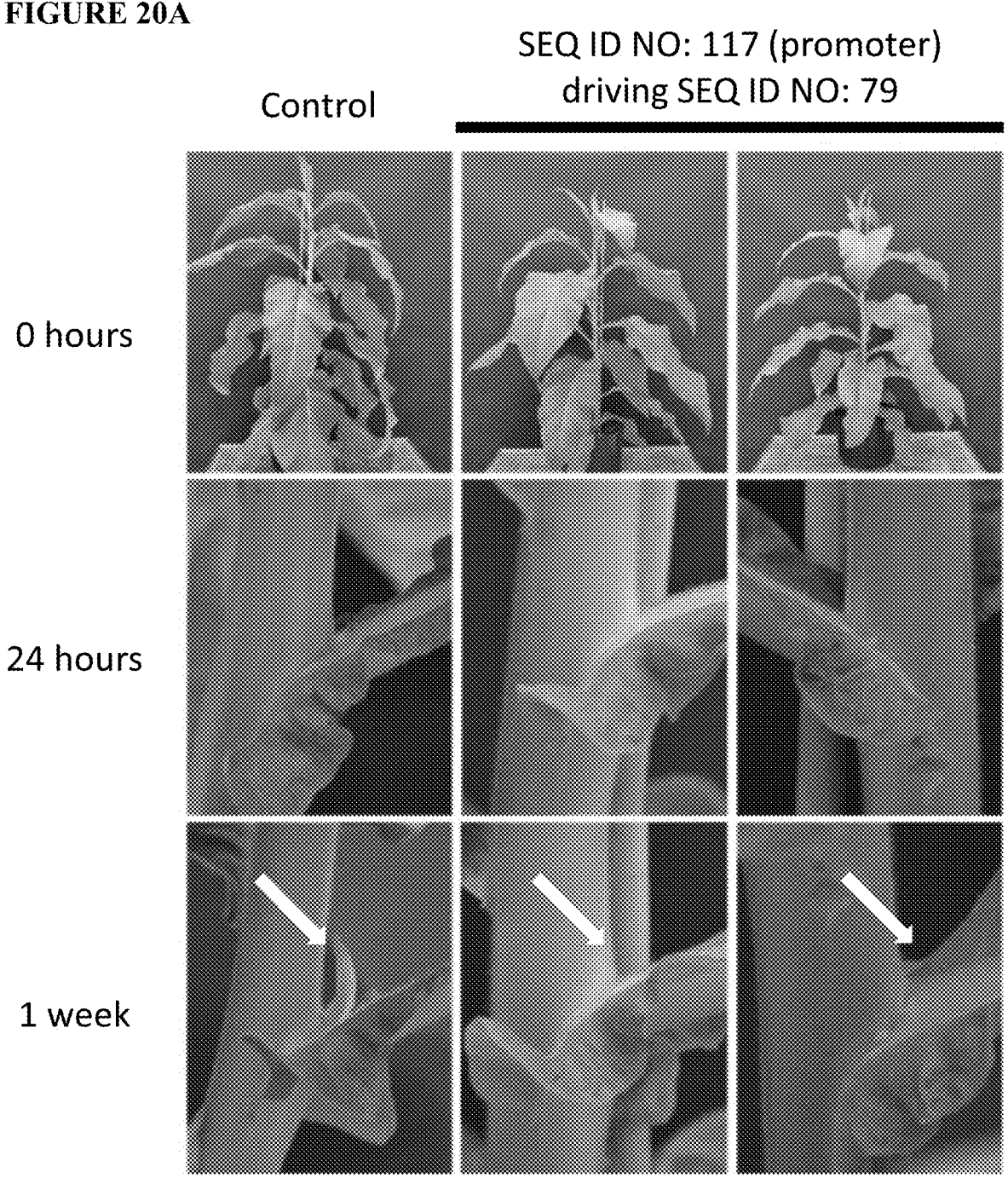
FIG. 20 shows photographs of control plants and two independent lines of modified tobacco plants that express SEQ ID NO: 79 (Barnase) under the control of Promoter P15 (SEQ ID NO: 117). Modified plants exhibit reduced sucker growth (arrows) compared to control plants one week after topping (FIG. 20A), two weeks after topping (FIG. 20B), and three weeks after topping (FIG. 20C).
Figure 20B:
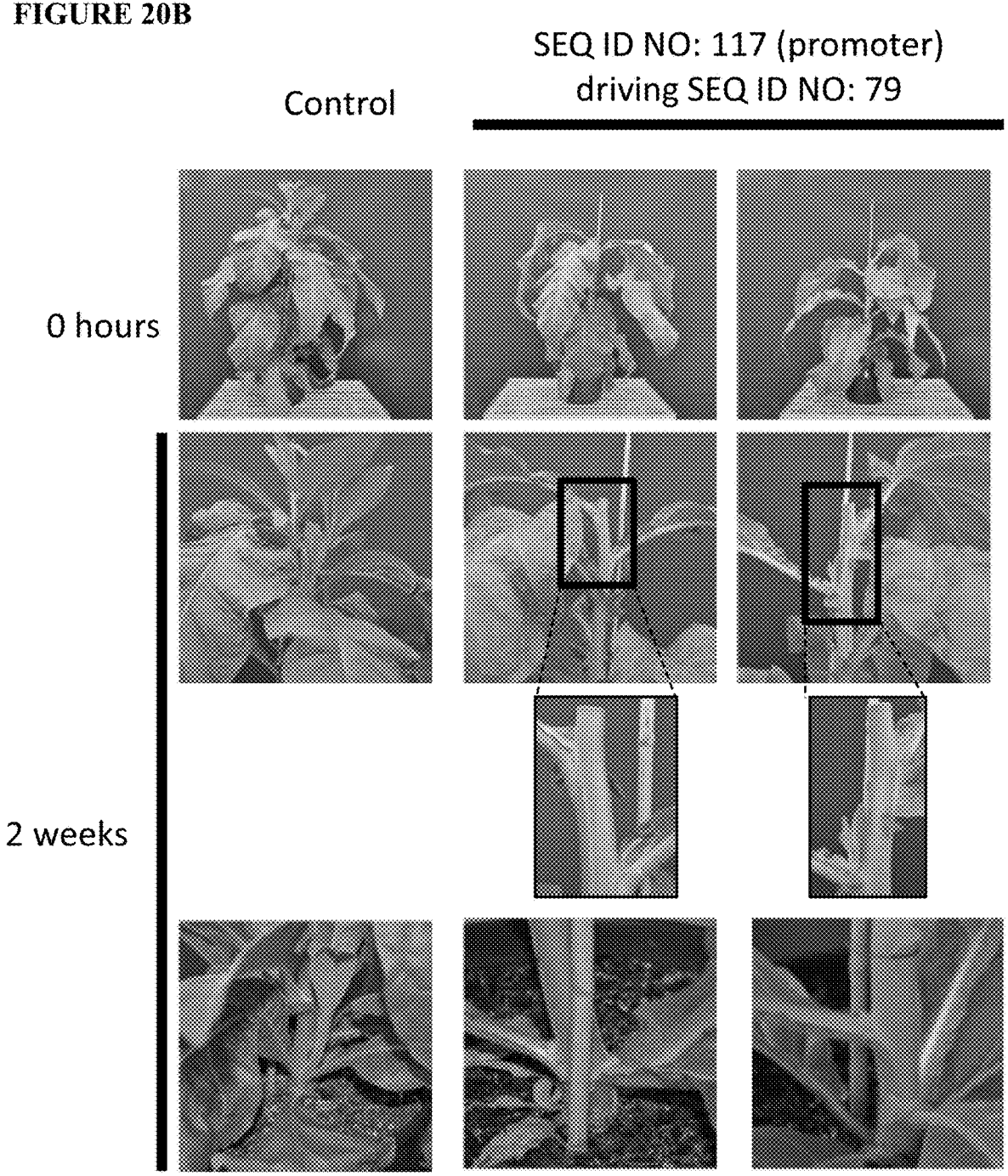
Figure 20C:
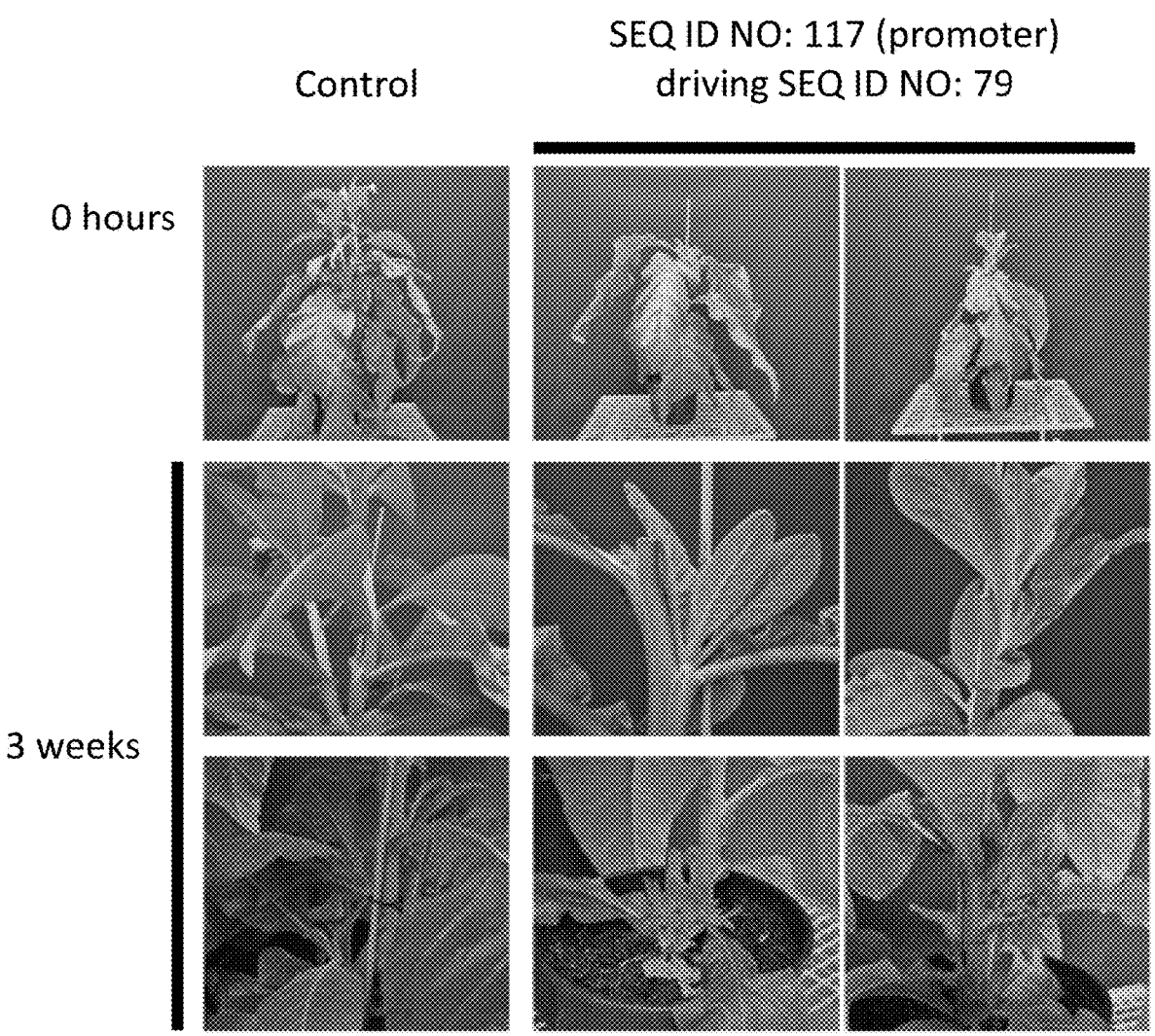

RNA-degrading enzymes, such as the bacterial RNase Barnase (SEQ ID NO: 79; and see, e.g., Hartley, 1989, *Trends in Biochemical Sciences* 14:450-454) are used to induce cellular death in the axillary bud when their expression is driven by Promoter P15 (SEQ ID NO: 117). A transformation vector is created according to Example 2 to comprise SEQ ID NO: 79 driven by Promoter P15 (SEQ ID NO: 117). Modified tobacco plants are then generated with the Promoter P15:Barnase vector according to Example 2. Modified tobacco plants (T0 generation) and control tobacco plants are grown to the layby stage, then plants are topped to remove the shoot apical meristem. Sucker growth is observed at the time of topping, 24 hours after topping, one week after topping, two weeks after topping, and three weeks after topping (FIGS. 19 and 20). Expression of SEQ ID NO: 79 driven by Promoter P15 eliminates sucker outgrowth in tobacco.

Additional transformation vectors similar to Promoter P15:Barnase are also created using endogenous tobacco RNases such as: RNase Phy3 (SEQ ID NO: 123), RNase H (SEQ ID NO: 124), RNase P (SEQ ID NO: 125), RNase III (SEQ ID NO: 126), and RNase T2 (SEQ ID NOs: 127-136) in place of Barnase (SEQ ID NO: 79). Each of these vectors is used to generate modified tobacco plants, and to then phenotypically evaluate the tobacco plants, as described in Example 2. The modified tobacco plants exhibit reduced sucker growth compared to control tobacco plants.

Example 17. Regulating Sucker Growth Using Vacuolar Processing Enzymes

Vacuolar processing enzymes (VPEs) are proteases that function in normal plant growth and development, and are also implicated in vacuole-dependent programmed cell death through their caspase-like activity. Eight out of 17 VPE proteins found in the tobacco genome comprise protease domains that contain all the residues required for caspase-like activity (SEQ ID NOs: 137-143). The expression of SEQ ID NOs: 137-143 is directed to axillary buds by driving their expression with Promoter P15 (SEQ ID NO: 117). Expression of proteins encoded by SEQ ID NOs: 137-143 can be further restricted to vacuoles within axillary bud cells by including an N-terminal vacuolar sorting signal.

Separate transformation vectors are created according to Example 2 to comprise one of SEQ ID NOs: 137-143 driven by Promoter P15 (SEQ ID NO: 117). Modified tobacco plants are then generated with the Promoter P15:VPE vectors, and then phenotypically evaluated, according to Example 2. The modified tobacco plants exhibit reduced sucker growth compared to control tobacco plants.

Example 18. Regulating Sucker Growth Using Proteases

Additional plant proteases are expressed in certain tissues to eliminate the cells responsible for axillary shoot meristem development. Proteolytic enzymes are divided into four groups based on their catalytic domain: aspartic proteases, cysteine proteases, metalloproteases, and serine proteases. All of these protease families are found in tobacco and are used to inhibit the development of axillary shoot meristems. For example, an aspartic protease (SEQ ID NO: 144), a cysteine protease (SEQ ID NO: 145), a metalloprotease (SEQ ID NO: 146), or a serine protease (SEQ ID NO: 147) are expressed with a tissue specific promoter (e.g., SEQ ID NOs: 113-118, 148-160, and 204). Separate transformation vectors are created according to Example 2 to comprise one of SEQ ID NOs: 144-147 driven by Promoter P15 (SEQ ID NO: 117). Modified tobacco plants are then generated with a Promoter P15:protease vector, and then phenotypically evaluated, according to Example 2. The modified tobacco plants exhibit reduced sucker growth compared to control tobacco plants.

Example 19. Genome Editing Using TALEN

Transcription activator-like effector nuclease (TALEN) technology is used to modify commercial tobacco varieties such as TN90, K326 and Narrow Leaf Madole. TALENs enable genetic modification through induction of a double strand break (DSB) in a DNA target sequence. The ensuing DNA break repair by either a non-homologous end joining (NHEJ) or a homology-directed repair (HDR)-mediated pathway is exploited to introduce a desired modification (e.g., gene disruption, gene correction or gene insertion).

PEG-mediated protoplast transformation is used to introduce a TALEN and a donor DNA molecule into a plant cell. Tobacco leaves from 4-8 weeks old tobacco plants from sterile culture are cut into small pieces and transferred into a petri dish containing filter-sterilized enzyme solution containing 1.0% Cellulase onuzuka R10 and 0.5% Macerozym. The leaf strips in the petri dish are vacuum infiltrated for 30 minutes in the dark using a desiccator. After incubation, the digested leaves are resuspended by shaking at 45 R.P.M. for 230 minutes, and then filtered through a sterilized 100 μm nylon filter by collecting in a 50 mL centrifuge tube. The solution is applied to Lymphoprep and separated via centrifugation at 100×g for 10 minutes. Protoplast bands are collected using a pipette, and purified protoplasts are washed with an equal volume of W5n solution containing NaCl, $CaCl_2$, KCl, IVIES, and glucose, prior to additional centrifugation for 5 minutes at 2000 R.P.M. Protoplast pellets are resuspended at $2\times10^5$/mL in W5n solution, and left on ice for 30 minutes. Next, supernatant is removed and protoplast pellets are resuspended in filter-sterilized MMM solution containing mannitol, $MgCl_2$ and IVIES.

PEG transfection of tobacco protoplasts is performed according to a method described by Zhang et al. (2013, *Plant Physiology* 161:20-27) with some modifications. A 500 μL aliquot of protoplast suspension is transferred into a 10 mL culture tube and 25 μL (~10 μg) of plasmid DNA is slowly added to the protoplasts suspension. Next, 525 μL PEG solution is added to the protoplast-DNA solution and mixed by carefully tapping the tube. Tubes are incubated for 20 minutes, then 2.5 mL W5n solution is added to stop the reaction. The solution is centrifuged at 100×g for 5 minutes, and washed with protoplast culture media. PEG-treated protoplasts are resuspended in 1 mL culture media containing 0.1 mg/L NAA and 0.5 mg/L BAP, and mixed with 1 mL low-melting agar to make protoplast beads. Protoplast beads are cultured in liquid media, and calli growing from protoplast beads are transferred onto solid shooting media. When shoots are well developed, they are transferred into a Magenta™ GA-7 box for root formation. When root systems are fully developed and shoot growth resumes, plants are transplanted into soil.

Multiple TALEN approaches are used to prevent or reduce sucker growth in tobacco. Instead of randomly inserting a gene into a tobacco genome using conventional transformation methods, TALEN is used for targeted replacement of an endogenous coding sequence. In one example, a coding sequence of interest (e.g., SEQ ID NOs: 123-147) can be placed under the control of an axillary bud-specific promoter sequence (e.g., SEQ ID NOs: 113-118, 148-160, and 204), and the construct can be used with a TALEN to homologously recombine the construct into the endogenous genomic region controlled by the promoter. A TALEN donor sequence is shown in SEQ ID NO:119, and a TALEN target sequence is shown in SEQ ID NO:120.

A second example places an axillary bud-specific promoter and a coding sequence of interest under the control of a native axillary bud-specific promoter to provide two doses of promoter control. A construct including a first promoter (SEQ ID NO:118), a second promoter (SEQ ID NO:113), and a coding sequence (SEQ ID NO:13) is homologously recombined into the genomic region containing native SEQ ID NO: 118 using TALEN, thereby directing expression of the coding sequence by both promoters (SEQ ID NO:118 and 113). A TALEN donor sequence is shown in SEQ ID NO:121.

A third example uses TALEN to disrupt a target gene that promotes sucker growth and/or development. TALEN target sequences are identified for nucleic acid sequences (e.g., SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 69, 71, 73, 75, 77, 108-110, 123-147, 186, 188, 190, 196, 198) and nucleic acid sequences encoding polypeptides (e.g., SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 70, 72, 74, 76, 78, 161-185, 187, 189, 191, 197, 199). Gene-specific TALENs are designed and introduced into tobacco cells to cause deletions or insertions in an endogenous target gene. For example, potential TALEN target sites in a coding sequence (SEQ ID NO: 11) are identified, and homologous recombination sites within the coding sequence of the gene are selected. A TALEN target sequence is shown in SEQ ID NO:122 (the target sequences are underlined).

Example 20. Additional Methods of Regulating Sucker Growth Using Gene Editing Technologies Gene editing technologies such as CRISPR/Cas9, CRISPR/Cpf1, zinc-finger nucleases (ZFN), and transcription activator-like effector nucleases (TALENs) are used to replace the coding region of an axillary meristem-specific gene with a cell death/axillary shoot suppressor sequence. These gene editing technologies are also used to edit or replace an endogenous promoter sequence to drive its cognate protein expression in axillary buds. For example, an endogenous RNase promoter is edited or replaced so the RNase is only expressed in axillary buds, where it can function to reduce sucker outgrowth via the induction of cell death. Alternatively, the promoter of an axillary meristem regulator gene is mutated (edited) to eliminate regulatory region(s) required for timely expression during sucker activation and/or outgrowth, which can lead to growth defects and/or death of axillary shoots. Gene editing technologies are further used to edit or replace of an endogenous gene that natively functions in axillary buds. An endogenous gene such as NtCET2 is edited so that it no longer makes a functional protein, thereby inhibiting sucker outgrowth.

Separate CRISPR/Cas9 or CRISPR/Cpf1 guide RNAs are constructed to recognize and hybridize to the promoter sequence of each one of SEQ ID NOs: 123-147. The engineered guide RNA and a donor polynucleotide comprising Promoter P15 (SEQ ID NO: 117) are provided to a tobacco plant, allowing Promoter P15 to replace the endogenous promoter of SEQ ID NO: 123-147 and restrict expression of endogenous SEQ ID NOs: 123-147 to the axillary bud. The edited tobacco plants exhibit reduced sucker growth compared to control tobacco plants.

Example 21. Development of Novel Mutations Via Random Mutagenesis

Random mutagenesis of tobacco plants are performed using ethyl methanesulfonate (EMS) mutagenesis or fast neutron bombardment. EMS mutagenesis consists of chemically inducing random point mutations. Fast neutron mutagenesis consists of exposing seeds to neutron bombardment which causes large deletions through double stranded DNA breakage.

For EMS mutagenesis, one gram (approximately 10,000 seeds) of Tennessee 90 tobacco (TN90) seeds are washed in 0.1% Tween for fifteen minutes and then soaked in 30 mL of ddH$_2$O for two hours. One hundred fifty (150) µL of 0.5% EMS (Sigma, Catalogue No. M-0880) is then mixed into the seed/ddH$_2$O solution and incubated for 8-12 hours (rotating at 30 R.P.M.) under a hood at room temperature (RT; approximately 20° C.). The liquid then is removed from the seeds and mixed into 1 M NaOH overnight for decontamination and disposal. The seeds are then washed twice with 100 mL ddH$_2$O for 2-4 hours. The washed seeds are then suspended in 0.1% agar solution.

The EMS-treated seeds in the agar solution are evenly spread onto water-soaked Carolina's Choice Tobacco Mix (Carolina Soil Company, Kinston, NC) in flats at 2000 seeds/flat. The flats are then covered with plastic wrap and placed in a growth chamber. Once the seedlings emerge from the soil, the plastic wrap is punctured to allow humidity to decline gradually. The plastic wrap is completely removed after two weeks. Flats are moved to a greenhouse and fertilized with NPK fertilizer. The seedlings are replugged into a float tray and grown until transplanting size. The plants are subsequently transplanted into a field. During growth, the plants self-pollinate to form M1 seeds. At the mature stage, five capsules are harvested from each plant and individual designations are given to the set of seeds from each plant. This forms the M1 population. A composite of M1 seed from each M0 plant are grown, and plants are phenotypically evaluated as described in Example 2. M1 plants exhibiting enhanced or reduced sucker growth are selected and screened for mutations using DNA sequencing and gene mapping techniques known in the art.

Example 22. Regulating Sucker Growth Using Inducible Promoters

Inducible promoters are also used to express a functional gene in a controlled manner to reduce or eliminate sucker development. These promoters are induced by either a chemical spray or at certain time points (i.e., after topping). Exemplary promoters include alcohol-regulated promoters; tetracycline-regulated promoters; steroid-regulated promoters (e.g., glucocorticoid (See, for example, Schena et al., 1991, *Proceedings of the National Academy of Sciences*

USA 88:10421-10425, which is herein incorporated by reference in its entirety); human estrogen; ecdysone); and metal-regulated promoters. For example, an RNase (e.g., SEQ ID NOs: 79 and 123-136), a VPE (e.g., SEQ ID NOs: 137-143), or a protease (e.g., SEQ ID NOs: 144-147) are expressed in a tobacco plant with an inducible promoter.

In one example, a first vector containing a rat glucocorticoid receptor under the control of a constitutive CsVMV promoter and a second vector containing a sequence of interest (e.g., SEQ ID NOs: 83-101) operably linked to one or more glucocorticoid response elements are created according to Example 2. Modified tobacco plants are then generated containing both of these vectors. Dexamethasone is sprayed on the plants to induce the expression of the sequence of interest, then the plants are phenotypically evaluated. The modified tobacco plants exhibit reduced sucker growth compared to control tobacco plants.

In a second example, a first vector containing a rat glucocorticoid receptor under the control of Promoter P15 (SEQ ID NO: 117) and a second vector containing a sequence of interest (e.g., SEQ ID NOs: 79 and 123-147) operably linked to one or more glucocorticoid response elements are created according to Example 2. Modified tobacco plants are then generated containing both of these vectors. Dexamethasone is sprayed on the plants to induce the expression of the sequence of interest, then the plants are phenotypically evaluated. The modified tobacco plants exhibit reduced sucker growth compared to control tobacco plants.

Example 23. Regulating Sucker Growth Using Phytotoxins and Immune Receptors

Tobacco plants are metabolically engineered to produce one or more phytotoxins (e.g., tabtoxin; coronatine; syringomycin; syringopeptin; phaseolotoxin) or immune receptors in an axillary meristem to inhibit cell growth or cell division within the axillary shoot meristem. See, for example, Bender et al., 1999, *Microbiology and Molecular Biology Reviews* 63:266-292, which is herein incorporated by reference in its entirety. As an example, the tabA/tblA genes from *Pseudomonas syringae* required to produce tabtoxin are expressed with a tissue specific promoter (e.g., SEQ ID NOs: 113-118, 148-160, and 204).

Immune receptor genes include wide range of genes. Some examples include *Arabidopsis thaliana* disease resistance protein RPS5 (SEQ ID NO: 222) and tobacco TMV resistance N gene (SEQ ID NO: 224).

A transformation vector is created according to Example 2 to comprise SEQ ID NO: 221 driven by Promoter P15 (SEQ ID NO: 117). Modified tobacco plants are then generated with a Promoter P15:RPS5 vector, and then phenotypically evaluated, according to Example 2. The modified tobacco plants exhibit reduced sucker growth compared to control tobacco plants.

Example 24. Regulating Sucker Growth Using Programmed Cell Death-Inducing Genes

The presence of some proteins at elevated levels, in cells where they are not normally expressed, or in subcellular locations where they are not normally located, can induce cell death. Axillary bud specific promoters, such as Promoter P1 (SEQ ID NO: 113) and Promoter P15 (SEQ ID NO: 117) are used to the express heterologous genes that in axillary bud cells and ultimately result in death of the axillary bud.

Programmed cell death-inducing (PCD-inducing) enzymes (e.g., transcription factors (SEQ ID NOs: 208, 210, and 212), kinases (SEQ ID NO: 214), cysteine proteases (SEQ ID NOs: 216 and 218), and caspases (SEQ ID NO: 220); see Table 6) are used to induce cellular death in the axillary bud when their expression is driven by Promoter P15 (SEQ ID NO: 117). Transformation vectors are created according to Example 2 to comprise SEQ ID NOs: 208, 210, 212, 214, 216, 218, and 220 driven by Promoter P15 (SEQ ID NO: 117). Modified tobacco plants are then generated with the Promoter P15:PCD-inducing enzyme vector according to Example 2. Modified tobacco plants (T0 generation) and control tobacco plants are grown to the layby stage, then plants are topped to remove the shoot apical meristem. Sucker growth is observed at the time of topping, 24 hours after topping, and one week after topping. Expression of PCD-inducing enzymes driven by Promoter P15 eliminates sucker outgrowth in tobacco.

TABLE 6

Programmed Cell Death (PCD)-Inducing Genes

| SEQ ID NOs (Nucleic Acid/Protein) | Gene Name | Species | Sequence Description | Sequence Source |
|---|---|---|---|---|
| 207/208 | ALCATRAZ | *Arabidopsis thaliana* | Transcription factor (myc/bHLH), fruit dehiscence | *Current Biology* 2001, 11: 1941-1922 |
| 209/210 | VND6 | *Arabidopsis thaliana* | Transcription factor, PCD- xylogenesis | *JEB* 2014, 65: 1313-1321 |
| 211/212 | VND7 | *Arabidopsis thaliana* | Transcription factor, PCD- xylogenesis | *JEB* 2014, 65: 1313-1321 |
| 213/214 | Adi3 | *Solanum lycopersicum* | AGC kinase, negative regulator, PCD with pathogen attack | *EMBO* 2006, 25: 255-265 |
| 215/216 | XCP1 | *Arabidopsis thaliana* | Cysteine protease, PCD-xylogenesis | *Plant Journal* 2008, 56: 303-315 |
| 217/218 | XCP2 | *Arabidopsis thaliana* | Cysteine protease, PCD-xylogenesis | *Plant Journal* 2008, 56: 303-315 |
|  | SlCysEP | *Solanum lycopersicum* | Cysteine protease, ricinosomal protease, PCD-endosperm | *Planta* 2013, 237: 664-679 |
| 219/220 | Metacaspase 2d (ATMC4) | *Arabidopsis thaliana* | Protease, PCD during biotic and abiotic stresses | *Plant Journal* 2011, 66: 969-982 |
|  | Caspase-like protease | *Solanum lycopersicum* | PCD, like apoptosis in mammalian cells | *Planta* 2000, 211: 656-662 |

Example 25. Regulating Sucker Growth by Regulating microRNAs miRNAs can be involved in the regulation of axillary bud development. See Ortiz-Morea et al., 2013, *Journal of Experimental Botany* 64:2307-2320; and Wang et al., 2010, *Molecular Plant* 3:794-806, which are herein incorporated by reference in their entireties. To identify miRNAs involved in tobacco sucker development, total RNA samples are extracted from axillary buds and phloem of 4 week old TN90 tobacco plants before topping and several time points after topping (e.g., 2 hours after topping, 6 hours after topping, 24 hours after topping, 72 hours after topping, 96 hours after topping). Small RNA (sRNA) are separated and purified from the total RNAs. The resulting sRNA samples (three independently collected samples for each tissue type) are processed and subjected to Illumina sequencing. The Illumina reads are mapped and used to evaluate the expression profiles of miRNAs and other small RNAs (e.g., small-interfering RNAs (siRNAs), trans-acting siRNAs). Small RNAs, including miRNAs, that exhibit differential expression in axillary buds before and after topping are identified. These sRNAs play a role in the formation or outgrowth of suckers. The identified sRNAs' precursor sequences and genomic sequences are subsequently identified.

Some tobacco sRNAs are associated with reduced sucker development and/or growth. Over-expression of these sRNAs is used to inhibit suckers. sRNAs found to be associated with reduced sucker development and/or growth are placed under the regulation of a promoter functional in an axillary bud (e.g., SEQ ID NOs: 113-118, 148-160, and 204), or a constitutive promoter (e.g., CaMV 35S) according to Example 2.

A transformation vector is created according to Example 2 to comprise sRNAs of interest driven by Promoters P1, P11, P15, or PAB Thionin (SEQ ID NO: 118). Modified tobacco plants are then generated and phenotypically evaluated according to Example 2. The modified tobacco plants exhibit reduced sucker growth compared to control tobacco plants.

miRNAs that promote sucker formation or outgrowth by repressing genes that would otherwise inhibit sucker formation or outgrowth are targeted for regulation by generating constructs comprising at least one miRNA decoy under the regulation of a promoter functional in an axillary bud (e.g., SEQ ID NOs: 113-118, 148-160, and 204), or a constitutive promoter according to Example 2.

A transformation vector is created according to Example 2 to comprise a miRNA decoy driven by Promoters P1, P11, P15, or PAB Thionin (SEQ ID NO: 118). Modified tobacco plants are then generated and phenotypically evaluated, according to Example 2. The modified tobacco plants exhibit reduced sucker growth compared to control tobacco plants.

A further transformation vector is created according to Example 2 to comprise a tobacco miR159 decoy driven by Promoter PAB Thionin (SEQ ID NO: 118). Tobacco mature miR159 (SEQ ID NO: 227) is complementary to at least SEQ ID NOs: 1, 13, and 35, which all function to inhibit sucker growth in tobacco. Preventing miR159-mediated degradation of SEQ ID NOs: 1, 13, and 35 reduces sucker growth. Modified tobacco plants are then generated with an axillary meristem promoter:miR159 decoy vector, and then phenotypically evaluated, according to Example 2. The modified tobacco plants exhibit reduced sucker growth compared to control tobacco plants.

Example 26. Regulating Sucker Growth Via Modifying Auxin Synthesis and Transport Removing the shoot apical meristem releases axillary buds from dormancy and promotes sucker outgrowth. Auxin derived from an intact shoot apical meristem suppresses sucker outgrowth. Typically, cytokinin induced by removal of the shoot apical meristem promotes axillary meristem outgrowth. Without being bound to any scientific theory, maintaining a high auxin: cytokinin ratio in and around axillary buds after removal of the shoot apical meristem can suppress axillary bud outgrowth.

Localized increases in auxin concentration in and around axillary bud regions can suppress sucker outgrowth. Genes related to auxin biosynthesis and/or transport are used to suppress axillary meristem outgrowth when their expression is driven by Promoter P15 (SEQ ID NO: 117) or other promoters functional in axillary buds (e.g., SEQ ID NOs: 113-118, 148-160, 204, and fragments thereof). A transformation vector is created according to Example 2 to comprise SEQ ID NO: 234 (YUCCA1; flavin monooxygenase) driven by Promoter P15 (SEQ ID NO: 117). Modified tobacco plants are then generated with the Promoter P15:YUCCA1 vector according to Example 2. Modified tobacco plants (T0 generation) and control tobacco plants are grown to the layby stage, then plants are topped to remove the shoot apical meristem. Sucker growth is observed at the time of topping, 24 hours after topping, one week after topping, two weeks after topping, and three weeks after topping (FIGS. 19 and 20). Expression of SEQ ID NO: 234 driven by Promoter P15 suppresses sucker outgrowth in tobacco.

Additional transformation vectors similar to Promoter P15:YUCCA1 are also created using other auxin biosynthesis and auxin transport genes from *Arabidopsis* such as: PIN-FORMED1 (PINE SEQ ID NO: 236); TRYPTOPHAN AMINOTRANSFERASE1/TRANSPORT INHIBITOR RESPONSE2 (TAA1/TIR2; SEQ ID NO: 238); ALDEHYDE OXIDASE1 (AAO1; SEQ ID NO: 240); and INDOLE-3-ACETAMIDE HYDROLASE1 (AMI1; SEQ ID NO: 242). In addition to Promoter P15, several promoters functional in axillary buds (e.g., SEQ ID NOs: 113-118, 148-160, 204, and fragments thereof) are used to drive the expression of auxin biosynthesis and auxin transport genes (e.g., SEQ ID NOs: 234, 236, 238, 240, and 242). Furthermore, tobacco genes homologous to *Arabidopsis* auxin biosynthesis and auxin transport genes (e.g., NtYUCCA-like, SEQ ID NOs:244 and 246; NtPIN1-like, SEQ ID NO:248; NtTAA1/NtTIR2-like, SEQ ID NO:250; NtAAO1-like, SEQ ID NO:252; and NtAMI1-like, SEQ ID NO:254) are included in separate vector constructs with Promoter P15 as well as other promoters (e.g., SEQ ID NOs: 113-118, 148, 160, 204, and fragments thereof) functional in axillary buds.

Each of these vectors is used to generate modified tobacco plants, and to then phenotypically evaluate the tobacco plants, as described in Example 2. The modified tobacco plants exhibit reduced sucker growth compared to control tobacco plants.

TABLE 7

Auxin biosynthesis and auxin transport genes

| SEQ ID NOs (Nucleic Acid/Protein) | Gene Name | Species | Sequence Description | Sequence Source |
|---|---|---|---|---|
| 234/235 | YUCCA1 | *Arabidopsis thaliana* | FLAVIN MONOOXYGENASE | *Plant Cell* 2007, 19: 2430-2439 |
| 236/237 | PIN1 | *Arabidopsis thaliana* | PIN-FORMED1 | *Science* 1998, 282: 2226-2230 |
| 238/239 | TAA1/TIR2 | *Arabidopsis thaliana* | TRYPTOPHAN AMINOTRANSFERASES TRANSPORT INHIBITOR RESPONSE2 | *Cell* 1998, 133: 177-191; *Plant Physiology* 2009, 151: 168-179 |
| 240/241 | AAO1 | *Arabidopsis thaliana* | ALDEHYDE OXIDASE1 | *J Biochem* 1999, 126: 395-401 |
| 242/243 | AMI1 | *Arabidopsis thaliana* | INDOLE-3-ACETAMIDE HYDROLASE | *FEBS J* 2007, 274: 3440-3451 |

SEQUENCE LISTING (256 sequences)

SEQ ID NO: 1 - DNA, 987 bp, Artificial Sequence
  Description of Artificial Sequence: Synthetic polynucleotide
atgtatccgccaagcaacagctgcaactacagccccattttcaacatcccttctccttgtatgcaatatggagacgaactattcttccaatattatcctgaccatttccttcaacagcaacaagtgcctttgatagaagatcagagtgttgacatcttagctgattgcactgagaatgttactaacgaagaaactgtcatcaatactgatactgtaaaagttctttatgacacaggagctgttacaaacagtcagtgttggggaggaaatgaagaagtagaagaaggccgcgaaaacaaaagaaatgacatgagaagcaccattagtattattcatgtacggaaaaacaagaaatgttccaataaagatcgacatagcaagattaacactgctcgtggcctcagagaccgaaggatgagactttcccttgatgcagctcgcaagtttttcagtttacaagacatgttggggttcgataaggcaagtaaaactgtagaatggttgcttatcaaatcggagtctgaaatcgaagagctagccaaaggcaataaaggaggaggcattcctaaacaaagctgcagtactactaatggaattggtgcaattagtactgcaatatcctctatttctgagtgtgaggttatatcaggaactgatgaatctttctctattacttataaaaagaagctgaaaactgctaaaggagcctcgaaaaagacggctaaaactgctcgtagagctgcatttgatcgtcttattacaagggaaacgaggaatcaagcaagggctagggctagagagagaacaaaaataaagaaaagcctcggtaaatccaaagagaacagtgctgattactgtaatttggtggataattatggagattggagtcaatttagtatcttcaactatcagaaaaatgcagttggaatttcccatgatcaggtgggttcaataattaaacaacatgattttttaggatttcaatag

SEQ ID NO: 2 - protein, 328 aa, Artificial Sequence
  Description of Artificial Sequence: Synthetic polypeptide
MYPPSNSCNYSPIFNIPSPCMQYGDELFFQYYPDHFLQQQQVPLIEDQSVDILADCTENVTNEETVINTDTVKVLYDTGAVTNSQCWGGNEEVEEGRENKRNDMRSTISIIHVRKNKKCSNKDRHSKINTARGLRDRRMRLSLDAARKFFSLQDMLGFDKASKTVEWLLIKSESEIEELAKGNKGGGIPKQSCSTTNGIGAISTAISSISECEVISGTDESFSITYKKKLKTAKGASKKTAKTARRAAFDRLITRETRNQARARARERTKIKKSLGKSKENSADYCNLVDNYGDWSQFSIFNYQKNAVGISHDQVGSIIKQHDFLGFQ

SEQ ID NO: 3 - DNA, 318 bp, Artificial Sequence
  Description of Artificial Sequence: Synthetic polynucleotide
atggctcgctccttgtgtttcatggcatttgcagtcttggcaatgatgctctttgttgcctatgaggttcaagctagagaatgcaaaacagaaagcaatacattccctggattatgcattaccaaaccaccatgcagaaaagcttgtatcagtgagggatttactgatggtcattgtagcaaaatcctcagaaggtgcctatgcactaagccatgtgtgttcgatgagaagatgatcaaaacaggagctgaaacttttgctgaggaagcaaaaactttggctgcagctttgcttgaagaagagataatggataactaa

SEQ ID NO: 4 - protein, 105 aa, Artificial Sequence
  Description of Artificial Sequence: Synthetic polypeptide
MARSLCFMAFAVLAMMLFVAYEVQARECKTESNTFPGLCITKPPCRKACISEGFTDGHCSKILRRCLCTKPCVFDEKMIKTGAETFAEEAKTLAAALLEEEIMDN

SEQ ID NO: 5 - DNA, 1797 bp, Artificial Sequence
  Description of Artificial Sequence: Synthetic polynucleotide
atggcttctcttccccttctcaccaccaatgccatctcttcatcagcttcttctttaaccaccacacctctttccaatttgcattcttctcctttctttacaaagacatcaaaagtttccactatagataagtgcagtaactatcgtttccaagtttcatgcaagggtacagaagatgaccaaaccatcaacacttccaaatcttctgattcttcaaacaataagatcattgatagaagaaacatgctacttggattaggaggcatttatggtgctgctactcttgttggtggtcatccctttgccttcgcggctcctgtgcccggacctgacgtttccaaatgtggtcctgcagatttgccaccaggtgcagcaccagtcaactgttgtcctccgacaacggcgaacatcatcgacttccaacttccaccaccgtcaaccaccctccgtacacggccagcagctcattccgccgatagtgcctatatagagaaattcaacagagctattcagctcatgaaacaacttccagataacgatccacgtagcttcaagcaacaagcaaatgttcattgtgcttactgtgatggagcttatggacaactaggtttcccaagttctgaactccaagttcattcctcttggcttttcttccctttccatcgttgttatctctacttcttcgaaaaaatcttgggaagtttaataaatgaccctactttcgctatcccattttggaactgggatcatcctgatggcatgagacttccggccatgtatgcgaaccgtagttcttctctcttcgatcctctccgtgatcagaagcatcagcctccggtcattgttgatctcgacttcaatggagcggatcctaacataagtaacgctcaacaaacttcccagaatctgacaatcatgtataggcaaatggtctctctaggaagtactccggcagctttcctcggagacccttaccgtgccggtggcgaaccgggtggtgctgggtccctcgagaacattccacatggaacggtccatgtttggaccggtgatagaacccaacctaattttgaaaatatgggagttttttatgcagctggtagagaccctattttctatgctcatcattctaatattgatagattgtggagtgtttggaaaaccctaggtggaagacgtcaagattttactgaccctgattttttaaattcttcgtttttgttttacgatgagaaagcacaaatggtacgtattagggtacgtgactgtttggatacaacaagacttggatacgtttatcaaggtgtagttaatccgtggataaattctcgtccaagggctagggtttcaagtgctttgagtagcgtaaggaggcttgctgaagcaaaagattatttcccaacaaaacttggccatgtgataagagtaatggtgaaaaggccaaataataaaaagagaaacaaggaggagaaagatgcaaaagaggagtttttagtggttgaagggatagagctggaaactgatgtttttgtcaagtttgatgtgttgattaatgatgaagatgagactgtaatttcgccgaataatgctgagtttgcaggtagttttgtgaacgtgccacatcttagtcatggtaagagtgacgagaaacgtaagactaagttgaagttggctataactgagctgctggaagatttagatgctgaggatgatgatcatgtggtggtgacttttgttccaaagaatggttctggtgctgtgaaaattggaggtgtcaagattgtgcttgaggattga

SEQ ID NO: 6 - protein, 598 aa, Artificial Sequence
  Description of Artificial Sequence: Synthetic polypeptide
MASLPLLTTNAISSSASSLTTTPLSNLHSSPFFTKTSKVSTIDKCSNYRFQVSCKGTEDDQTINTSKSSDSSNNKIIDRRNMLLGLGGIYGAATLVGGHPFAFAAPVPGPDVSKCGPADLPPGAAPVNCCPPTTANIIDFQLPPPSTTLRTRPAAHSADSAYIEKFNRAIQLMKQLPDNDPRSFKQQANVHCAYCDGAYGQLGFPSSELQVHSSWLFFPFHRCYLYFFEKILGSLINDPTFAIPFWNWDHPDGMRLPAMYANRSSSLFDPLRDQKHQPPVIVDLDFNGADPNISNAQQTSQNLTIMYRQMVSLGSTPAAFLGDPYRAGGEPGGAGSLENIPHGTVHVWTGDRTQPNFENMGVFYAAGRDPIFYAHHSNIDRLWSVWKTLGGRRQDFTDPDFLNSSFLFYDEKAQMVRIRVRDCLDTTRLGYVYQGVVNPWINSRPRARVSSALSSVRRLAEAKDYFPTKLGHVIRVMVKRPNNKKRNKEEKDAKEEFLVVEGIELETDVFVKFDVLINDEDETVISPNNAEFAGSFVNVPHLSHGKSDEKRKTKLKLAITELLEDLDAEDDDHVVVTFVPKNGSGAVKIGGVKIVLED

SEQ ID NO: 7 - DNA, 1392 bp, Artificial Sequence
  Description of Artificial Sequence: Synthetic polynucleotide
atggtaggcaaaagaaatgagcctcatgtcatatttgtaccttacccaagccaaggtcacattaaccctcttctccaatttgcaaaacgcttatactccaaaggtgtaaaagcaactttagccactactaaatacacagtcaagtctattaattcacccaacatttcagttgaagcaatttctgatggatttgacgaaagtggtttttcccaagcccaaaaagcagatatatatctcaaatcattcaaagaaaatggttcaacaactctatcagaaataataaaaaattacgagaattcgacacatccgataagttgcattgtttatgattcgtttttaccatgggctcttgatgtggctaaaaaacatgggatttatggagctgcgttttttacaaattcagccactgtttgtgtagtttttgctcacattcattataaaacattttcattgccggcgaagattgaagaaaatgagccattgttattgcctggattgcctagtttgtacccaattgatgttcctggatttattagggagcctgaaagttaccctgcttacttagccatgaaaatgagtcaattctctaatttggaaaatgctgattgggtttttgataactcctttcaagaactagaaggagagatagcaagtggagtttcaaatatttggccagcaaggttaattggaccaatggtgccatcatcctatttagatgacataatagaaggtgacaaagggtacggagcaagtctatggaaaccacttagtgaagaatgtctcaaatggctaaaaacaaagccaaatcaatcagtaatctacatttcttttggcagcatggtatcactcacaccacaacaaatggaagaaatggcaaatgctttaatagacagcaacatgaatttcctttgggttgtaagagaaaccgaaaaaggcaaattgccaaaaaaattcatagaatccacaattggaaaagggttaattgtgtcatggtgcaatcaattagaaatgctagcaaatcaagccattggttgttttgtgactcattgtggatggaattcgactcttgaaggattgagccttggcgtgccaatggtggcaatgccacaatggtctgatcaaatgacggatgctaaatttataggtgagatttgggaaattggtgtgaggcctaagttggataagtttgggattgttagaagagaagagctattgttttgtttaaaggaagtaatgggagggaagaggagttatgagattaggagaaatgctggaaaatggaagaacttggctaagaaagcaattagtgaaggaggtagctcggacaagtctattaatgtatttgtgaacagtcttagtctagcatgccagatgaagaagtacaagaaataa

SEQ ID NO: 8 - protein, 463 aa, Artificial Sequence
  Description of Artificial Sequence: Synthetic polypeptide
MVGKRNEPHVIFVPYPSQGHINPLLQFAKRLYSKGVKATLATTKYTVKSINSPNISVEAISDGFDESGFSQAQKADIYLKSFKENGSTTLSEIIKNYENSTHPISCIVYDSFLPWALDVAKKHGIYGAAFFTNSATVCVVFAHIHYKTFSLPAKIEENEPLLLPGLPSLYPIDVPGFIREPESYPAYLAMKMSQFSNLENADWVFDNSFQELEGEIASGVSNIWPARLIGPMVPSSYLDDIIEGDKGYGASLWKPLSEECLKWLKTKPNQSVIYISFGSMVSLTPQQMEEMANALIDSNMNFLWVVRETEKGKLPKKFIESTIGKGLIVSWCNQLEMLANQAIGCFVTHCGWNSTLEGLSLGVPMVAMPQWSDQMTDAKFIGEIWEIGVRPKLDKFGIVRREELLFCLKEVMGGKRSYEIRRNAGKWKNLAKKAISEGGSSDKSINVFVNSLSLACQMKKYKK

SEQ ID NO: 9 - DNA, 405 bp, Artificial Sequence
  Description of Artificial Sequence: Synthetic polynucleotide
atggcagggaaggttgagaaagtgcttgcagtagtgatgcttgcaatgcttctgttttcggagcatttaatggctgctaatcatgaaattaaaacaactgaagataactctactattagccctttctgcttagtaaaatgtttatttggatgtagggggttgccacctgtacaagcatccatttgtgctgctcaatgttatttaaagtgccgtgaccaagatgcggccaatattgctgaaactaagggcataattggtgagactgcatacaaccagtatgatgttggatgtgcccttggctactgctctgagttcctgttgaattatgatgagaagaggttcaagtgctgcatggaatactgccgcgaggacaaaatgatttgtcctgttgaggctgcagcttga

SEQ ID NO: 10 - protein, 134 aa, Artificial Sequence
  Description of Artificial Sequence: Synthetic polypeptide
MAGKVEKVLAVVMLAMLLFSEHLMAANHEIKTTEDNSTISPFCLVKCLFGCRGLPPVQASICAAQCYLKCRDQDAANIAETKGIIGETAYNQYDVGCALGYCSEFLLNYDEKRFKCCMEYCREDKMICPVEAAA

SEQ ID NO: 11 - DNA, 630 bp, Artificial Sequence
  Description of Artificial Sequence: Synthetic polynucleotide
atgaattcaaagaaaaacaactcaccaagaaaaaggttgagaaaatatcatacaagaaaagctcctattattagctcttatatggacatggctgaagctagaagagaaattgttcatgctttacaacttcatcgatcttcatcttcatctccaactccgtctattaatagcccaaagaagtacacattattgggtcaaggagttgtaagctctcaacaatattactattactcaatagtggaatctatgcctattcctgaaccaacatggtctacaacggctccggcaatacttaatgcactgccaccgctgccgctgccgctgccgccacctccgccgctgtcttcttcttccggtgaagttccagagtttgaatggtggatagggtttttgaagtcgttggacggcaagaagagtgctaacaatggtgaagtagtcatagaaaaatattttcctctagaagaaaatgttttgatggaaaattcaaagacaggttttggtcaattagaacatggattaaacagtgagtctcctaattgtatagataagaatgatgatcctaattaccaatttccagatgagtggttgattatccctacagctgatgatgattatgtacttgagctttaa

SEQ ID NO: 12 - protein, 209 aa, Artificial Sequence
  Description of Artificial Sequence: Synthetic polypeptide
MNSKKNNSPRKRLRKYHTRKAPIISSYMDMAEARREIVHALQLHRSSSSSPTPSINSPKKYTLLGQGVVSSQQYYYYSIVESMPIPEPTWSTTAPAILNALPPLPLPLPPPPPLSSSSGEVPEFEWWIGFLKSLDGKKSANNGEVVIEKYFPLEENVLMENSKTGFGQLEHGLNSESPNCIDKNDDPNYQFPDEWLIIPTADDDYVLEL

SEQ ID NO: 13 - DNA, 1143 bp, Artificial Sequence
  Description of Artificial Sequence: Synthetic polynucleotide
atgtatccgtcaagcaacagctgtaattacagcctcaatatttcctcctcaaataacttatttcacattccatctccgaattctatgcaatatgaacacgaacttttccaatattttcatgaccatcatctccttcaaccccaacaacaacaacaacaacaacaactcttgactacacctgatcattatatggcagcagattccaacaaagacaccgtaatcagtagtactaatcaagatcctgaagaagttgaattacaaggccgctgcaagaacaaaaaaggtgacaataagagacgtgttgcttacaagaaagatagacacagcaagattaacactgctcacggccctagagaccgaagaatgagactttctctcgatgtagctcgcaaatttttcaatttgcaagacttgcttggattcgataaggctagcaaaactgtggagtggttgctaacaaagtccaaatgtgctgtcaatgagctcgtccaaggcataaataaagaaaattgcgctactgctaatattggtgcaattagtacatgctctactacatctgagtgtgaagttgtatcaggaattgatgaatctacaaccactaatgatattcagaagcagtcaaatagaggtaaagtaggggagaagaagaaggctaataaactagttcgtagagctgcatttaatcctgtggcaaaggaatcaagaaagcaagctagagcgagggcaagggagagaacaaaaataaagaaaagctttttaaatattggtgatcagtctatggcggctgatgatttaaaacgattaggatgttggagtctttttgaaacaggtgaagaatcaggtattcaaggtactaatcatcaaattgaagaacacaccacgcaccacgaggagcctcttttggggactaatgagaatgttgatgattgtaatttggttgttaccggcaactggaacccatataccatcttcaattatcaccacagtactgaaatttctcacgaggtaggttttacacttcatttaaatccaagagtaattcttttagagttcaagattctgatattttttttggtggcgagaccctttcttatatcaaagcaaccttcaaggtacatacaagattggataaaccaattctga

SEQ ID NO: 14 - protein, 380 aa, Artificial Sequence
  Description of Artificial Sequence: Synthetic polypeptide
MYPSSNSCNYSLNISSSNNLFHIPSPNSMQYEHELFQYFHDHHLLQPQQQQQQQQLLTTPDHYMAADSNKDTVISSTNQDPEEVELQGRCKNKKGDNKRRVAYKKDRHSKINTAHGPRDRRMRLSLDVARKFFNLQDLLGFDKASKTVEWLLTKSKCAVNELVQGINKENCATANIGAISTCSTTSECEVVSGIDESTTTNDIQKQSNRGKVGEKKKANKLVRRAAFNPVAKESRKQARARARERTKIKKSFLNIGDQSMAADDLKRLGCWSLFETGEESGIQGTNHQIEEHTTHHEEPLLGTNENVDDCNLVVTGNWNPYTIFNYHHSTEISHEVGFTLHLNPRVILLEFKILIFFLVARPFLISKQPSRYIQDWINQF

SEQ ID NO: 15 - DNA, 915 bp, Artificial Sequence
  Description of Artificial Sequence: Synthetic polynucleotide
atggaaaaggttcatgagaaaccgctatctctttataatggatcattatctgtttttagattaggagatttggctgtgaaaataacaaaggtgaaaaagggatcattaaataatgataatctttcacccccaacttcattgttagttgtttcaccaatcataccaggaacttatccagttttactcttttttcatggcttcgttctcaagcctatatggtacaagtctctccttcaacatatttcttcccacggctatatagttgttgctccacaggtttctcaaagcgaagaagtgaaaaaagcagccaaagttacagaatggttaagtaaagccctcgaatccgtactgccggagaaagtacagccggatctactccagctcgccgtctccggccacagcagaggtggtaaaatagcatttgcactagctttaggatatggcatcaaatttcaagcacttctaggaattgatccagttgcaggtttttctccgtccaaccgatctgctccaaaaattcttaaatatattcctcgtattttcgatcagacggtccctgtggcggtgatcggcgctggcttgtcaaaccaaagtgcgaattgtatctttccacccttcgcaccaaacggtgtcaaccattcggagttttttaacgagtccaaaccaccttgctgttattttctggctaaaaattatggacatactgatatgttagatgacagaattgctgcaattgcgagttggatttcaaagagtgggaagggacccaaggaccttatgagaaaggctgttggagggattgttgtggcttttcttgaggctaaattgggagagaaagtggataatctaaatgccattgttcaagaaccttctcttgctcccatcatccttgacccagtcatatctgtcaaataa

SEQ ID NO: 16 - protein, 304 aa, Artificial Sequence
  Description of Artificial Sequence: Synthetic polypeptide
MEKVHEKPLSLYNGSLSVFRLGDLAVKITKVKKGSLNNDNLSPPTSLLVVSPIIPGTYPVLLFFHGFVLKPIWYKSLLQHISSHGYIVVAPQVSQSEEVKKAAKVTEWLSKALESVLPEKVQPDLLQLAVSGHSRGGKIAFALALGYGIKFQALLGIDPVAGFSPSNRSAPKILKYIPRIFDQTVPVAVIGAGLSNQSANCIFPPFAPNGVNHSEFFNESKPPCCYFLAKNYGHTDMLDDRIAAIASWISKSGKGPKDLMRKAVGGIVVAFLEAKLGEKVDNLNAIVQEPSLAPIILDPVISVK

SEQ ID NO: 17 - DNA, 1353 bp, Artificial Sequence
  Description of Artificial Sequence: Synthetic polynucleotide
atgtgtttgttaataaaggtggcgaatccaggagaatccggcgagcatgacagaattccatcaacgggaggtgattcagaaagtacaactactaccacagaaggaggaattccgcagctatatgaacaattacaatcacaatcacaatcatttgaagaaatgttgcggcaacaaatacaacaagaaacagagtatttgatgtcttcatctgcaactcctatgttttcacggtatagtcagacaagggagatgtcggcaatggtaacggcgttaacgcatgtggtatcaggacggagagagggagagtggacttacaggccggatattagtgccggcgctgttacgacgtcgtttgctggtggttcgagtatttattcggcgagttcgccgtcgtcttcaagttcagggtcatgggctggacagaagagaagacgtgatcaagaagaaagtgttgctgcagagcaagttcaaagggtttatggagcttttggtgaatttagaggtggagaatcatcttcctctgttaaaactgaagaagcttcaagcatggtagcaccaccaaccaccaccagcactaccaccacaaccaccacggcggcgcaaacaccaccagaaccagcggaaggaggaggagctgaagaaacaggggaaaggaggaggagatacagaggagtaagacaaaggccatggggaaaatgggcagcagaaataagagatccacacaaagcagctagagtttggttaggcacatttgatacagctgaagctgctgctagagcttatgatgaagctgcccttagattcagaggaaacagagctaaactcaatttccccgaaaatgtccgcatattaccacaacaacaacagcaacaacctcaagccacaacaagatcagccatttccagctcctccgcagcttcacaattcccattaatggctgcagcaacaactccatcaccatttttccaaacttatcaacctcagcagcagcagctgccttttcagagttcagaaatggttagagattattgggaatactcacagttacttcaaaatccaggagagtttcatttacaacaacagccttcagccttgttagagcaaatgttgtttgcttcttcatcaatgggtcttttgcaatcacacacattcccttcttattcttcatcttcctcattagctacttcctctgcagcttcttcccctgcatatcccctgttttactctgctcaacaatcacgtttctttcagcccccacaaagtactcatcaaaatcaaactagtagcagcagctccagttttcctgcaccattttggactagttcaacccactacccaccttcttctagttaa

SEQ ID NO: 18 - protein, 450 aa, Artificial Sequence
  Description of Artificial Sequence: Synthetic polypeptide
MCLLIKVANPGESGEHDRIPSTGGDSESTTTTTEGGIPQLYEQLQSQSQSFEEMLRQQIQQETEYLMSSSATPMFSRYSQTREMSAMVTALTHVVSGRREGEWTYRPDISAGAVTTSFAGGSSIYSASSPSSSSSGSWAGQKRRRDQEESVAAEQVQRVYGAFGEFRGGESSSSVKTEEASSMVAPPTTTSTTTTTTTAAQTPPEPAEGGGAEETGERRRRYRGVRQRPWGKWAAEIRDPHKAARVWLGTFDTAEAAARAYDEAALRFRGNRAKLNFPENVRILPQQQQQQPQATTRSAISSSSAASQFPLMAAATTPSPFFQTYQPQQQQLPFQSSEMVRDYWEYSQLLQNPGEFHLQQQPSALLEQMLFASSSMGLLQSHTFPSYSSSSSLATSSAASSPAYPLFYSAQQSRFFQPPQSTHQNQTSSSSSSFPAPFWTSSTHYPPSSS

SEQ ID NO: 19 - DNA, 732 bp, Artificial Sequence
  Description of Artificial Sequence: Synthetic polynucleotide
atggcacatttcttctctataaattcaacgttagcaggaacgaataaagcatccaaaacaaatttcacatattcaactcaagaaacagaaaaaccaaaaataaagatcatcttactcttgttttctcttgcattagttcccttgtcagcgatggcaacttgcaccactgatactccaaaccaagcactattgagggatgtacacgatatagatggtaacccccttcaagtaaaagccaggtacttcatatttccagttattggcggtggtggtgtacggcttgctaatcttggagatcaagacgaaaacgcttgtgccacagcggtggtgctatcacgcagtgaagttgacaaaggtaaagcagtcaacttcatacctaaagaccccaaacatgagaagattgtggaggcctcttcagtaaacatccagttttatcttgattattataagtgtgctaacctaactgtgtggaaagtagacaactaccctacacttccaagtcgctacaccataagcacaggtgcaacgccgggaaatcccctagagttgaatagctggtttcaaattatgtctcttggtggctcgacgtataagatagtcttctgtccctttggagaatgccaaaatgttggcattgccgaggaaaatggatataatcgtttggttctcgcagagaatgcaaaggcctttgttttcataaagcaaggcggatatggaaaggccgaagcatga

SEQ ID NO: 20 - protein, 243 aa, Artificial Sequence
  Description of Artificial Sequence: Synthetic polypeptide
MAHFFSINSTLAGTNKASKTNFTYSTQETEKPKIKIILLLFSLALVPLSAMATCTTDTPNQALLRDVHDIDGNPLQVKARYFIFPVIGGGGVRLANLGDQDENACATAVVLSRSEVDKGKAVNFIPKDPKHEKIVEASSVNIQFYLDYYKCANLTVWKVDNYPTLPSRYTISTGATPGNPLELNSWFQIMSLGGSTYKIVFCPFGECQNVGIAEENGYNRLVLAENAKAFVFIKQGGYGKAEA

SEQ ID NO: 21 - DNA, 471 bp, Artificial Sequence
  Description of Artificial Sequence: Synthetic polynucleotide
atggctgagcaacaccagcgccaccagcaacagcagcagcagcagcagatgcaagtgggccacccgacggaggcaatcaagagccttcttcctcaaaggggtccctctaaatcccaagtccttgctgtcgtcactctcttccctgttggtggggccctcctctgccttgctggactgacgctcgccggaactctgatcgggcttgcagtcgctacgccggttttcttactgttcagcccggttttggtccccgctgccctgacaatcgcgttggccgtcactggattcttgacttccggcgcctttggaataacggcgctgtcgtcgctctcgtggatcattaactatatgaggagaatcacaggtccagcagcagagcagatggagcatgcaaagcggagggtgcaggacactgctggtcatatgggacagagaggtggacagaagattcaagaaactgctagaacttga

SEQ ID NO: 22 - protein, 156 aa, Artificial Sequence
  Description of Artificial Sequence: Synthetic polypeptide
MAEQHQRHQQQQQQQQMQVGHPTEAIKSLLPQRGPSKSQVLAVVTLFPVGGALLCLAGLTLAGTLIGLAVATPVFLLFSPVLVPAALTIALAVTGFLTSGAFGITALSSLSWIINYMRRITGPAAEQMEHAKRRVQDTAGHMGQRGGQKIQETART

SEQ ID NO: 23 - DNA, 1437 bp, Artificial Sequence
  Description of Artificial Sequence: Synthetic polynucleotide
atggatagtgataggagggattgccacttgaacatgttgtccaaaatggctatgtgcaaatcacacgggcaagactcttcctatttcataggatggcaagaatatgagaagaacccttatcatcccattcaaaatccttctggtattattcagatgggtcttgctgagaatcagctctcattcgatcttcttgaatcatggctcacaagaaaccaagatgtaatccagtttagagaaaatggaggatctatgttcagagacttggctcttttccaagattatcatggattgcaggctttcaagaacgtactagtgtcattcatgggtgagatcagaagaaggaaagtaaaatttgatccagagaagctagtactcacagctggttcaacttcagcaaacgaaaccctcatattttgcttagctgaacctggagaagctctccttcttccaactccttattatccagggtttgatagagatctaaaatggagaacaggggctgaaattgtacccatacactgctacagttcaaataacttcagaataactgagtctgcccttgaagatgcatatgaagaagcccaacgacttaatttaagagtcaagggtgtatttatcacaaatccttcaaatccactagggacaaccatgtcacgagacgaattaaacaatcttatcacctttgccatggccaaaaatattcatatagttagcgacgaaatatacgctggaacagttttcgattcgccaaaattcataagcataatggaagctttaattgacagaaaacatgaaaaatccaaaatgtggagtcaagttcacattgtgtcaagtctatcaaaagatctaggtctaccaggtttcagaattgggatgatttattcaaacaatgaaactcttatagctgctgctacaaaaatgtcaagttttggactcatttcatctcaaactcagtatctactatctaaaattcttggagataaaaaatttataaaacgttacattaaagaaaacaagaaaggattgaaaaagaggagggaaatgcttgtttccgggttagagaatagtgggattgagtgtttgaaaagtaatgctggattattttgttttgtggacatgaggcatttgctaaattcaaacacatttgaagcagaaatggaactgtggagaaaaatactactaagtgatgttggtttaaatgtgtctcctggatcttcttgtcactgtagtgaacctggttggtttaaaatttgttttgcaaatattgccgaagaaactcttgatctcgcgatgcagaggattaatgattttgtcagttctatgaatcttcaacggcgacagctgatcgcggcggcgtcggcgtctagctcaaggaggaggacacttgcgaactgggttgttaagttatcttcaggtgaaggaaaaacatatcgttaa

SEQ ID NO: 24 - protein, 478 aa, Artificial Sequence
  Description of Artificial Sequence: Synthetic polypeptide
MDSDRRDCHLNMLSKMAMCKSHGQDSSYFIGWQEYEKNPYHPIQNPSGIIQMGLAENQLSFDLLESWLTRNQDVIQFRENGGSMFRDLALFQDYHGLQAFKNVLVSFMGEIRRRKVKFDPEKLVLTAGSTSANETLIFCLAEPGEALLLPTPYYPGFDRDLKWRTGAEIVPIHCYSSNNFRITESALEDAYEEAQRLNLRVKGVFITNPSNPLGTTMSRDELNNLITFAMAKNIHIVSDEIYAGTVFDSPKFISIMEALIDRKHEKSKMWSQVHIVSSLSKDLGLPGFRIGMIYSNNETLIAAATKMSSFGLISSQTQYLLSKILGDKKFIKRYIKENKKGLKKRREMLVSGLENSGIECLKSNAGLFCFVDMRHLLNSNTFEAEMELWRKILLSDVGLNVSPGSSCHCSEPGWFKICFANIAEETLDLAMQRINDFVSSMNLQRRQLIAAASASSSRRRTLANWVVKLSSGEGKTYR

SEQ ID NO: 25 - DNA, 645 bp, Artificial Sequence
  Description of Artificial Sequence: Synthetic polynucleotide
atgaacggtggttcatgtggtggtgctgatcgtgagtataataacaataacaacaataatgttgtaggtggaggaggtggcgggccttgtggtgcatgcaagtttcttagaagaaaatgtgtgaggggatgcatatttgcaccttattttgattctgatcaaggcactgctcatttcgctgctgtacataaggtgtttggtgctagcaatgcctctaaattgctgctcagaattccagcgcataaacgtctggatgctgtcgttacactttgctatgaggctcttgctagagttagagaccctatctatggttgtgttgctcacatctttactcttcagcaacaggttgtaactttgcaagctgagttagcatatgttcaagcccgcctttctaccctaccacacctacctatgcgacaaagtccaattacaccaacagggctgcaatcatcttcagatatcttctgcactacttcaagcatatcatcttcaagtaataatatggaatatcctcaatttgacataactgcgggtttaagtgattcgttcgatgaaaaagaactggagaactttgagctccatacattagcacgagagttggtttctagacacttacctggagttagatttagaccttcaccataa

SEQ ID NO: 26 - protein, 214 aa, Artificial Sequence
  Description of Artificial Sequence: Synthetic polypeptide
MNGGSCGGADREYNNNNNNNVVGGGGGGPCGACKFLRRKCVRGCIFAPYFDSDQGTAHFAAVHKVFGASNASKLLLRIPAHKRLDAVVTLCYEALARVRDPIYGCVAHIFTLQQQVVTLQAELAYVQARLSTLPHLPMRQSPITPTGLQSSSDIFCTTSSISSSSNNMEYPQFDITAGLSDSFDEKELENFELHTLARELVSRHLPGVRFRPSP

SEQ ID NO: 27 - DNA, 2205 bp, Artificial Sequence
  Description of Artificial Sequence: Synthetic polynucleotide
atgtcggataaaaaatctgtctcgacgccatttgaatgttgcagaatcttgtttaagtttctgctgtttatggttattatcagtaatgtggcgatccatgtaacagctttgagtgggcgagaaggaataaccccaagtacggaatggggtttggggcctctggtgaagagaggagaaagaaaactagtagtttcaactgaaaatggggaggtctcttcagtcagagtagctgatggaatcaccggttcctatcatcttcagttcatcacattggagcccaattccctcttccttcctgttgttctacatgcagatatggtcttctatgtccacactgggtcgggaaggctgacttggatggatgaaactgaacaaaagtcagtggatttaagaattggagatgttttcaggttgccctttggaactattttcttcatagagagcaacttagagcctgcgcgacagaaacttagagtttattccatctttaccaattcaggggatgatttgagagagccgttgtccggaccacactctagcatccgtgatatggttcttggattcgataggaaagttctccaggcggcatttcatgtaccagaggatgtgatagatgaagtgttgaatgggacagaagtaccagccatcatacatggtgtgcccaagacaacaaaaaagaccctgtgggaaatggaggctcaattcatgaaaagtcttctaggaaggggtggtcacggtttctttgactcccaaagcaataaaaagaagactgaattgttcaatattttcaaagagaaaccagattttgagaattgcaatggctggagcactgtaattacacggaaaaaattacccgcattaaagggttcccacattggtatttatgtagtgaacttaaccaagggatcaatgatggcgccacactggaatccaacggcaactgaaataggaatagcattgcaaggagaaggaatggtaagggtagtttgctcaagcacgggaacaaagcaaggatgccaaaacatgaggtttaaggtggaagaaggagatgtatttgcagtgccaaggtttcgtcctatggctcaaatggctttcaacaacaactcatttgtctttgttggttttagtacaactacaaagagacatcatcctcagtacctaacagggaaggcttcagtcctccgaacactggataggcaaatcttggcagcttcctttaatgtgactaacacaacaatggatcggattctggaggcacagggtgagtcagtcatactggagtgtacttcttgtgctgaagaagaagtgagattaatggaggaagaaaggaggagggcagaggaggaagaaaggagaagggaagaagaggaggcaaggcagagggaggaagaaaggaggagggaagaagaggaagctagaaggaaggaagaggaagaagcaaggaaggctgaagaagaaagaagaaagagagaggcagaagaagcaagaagacgagaagaggaggcaacaagggagaaagaggaacaaaggaggagacaagaagaagaagccaggagaagggaagaggaggaagccagaaggcaagaagaagaaatcagaaggagacaagaagaaggggaagctaggaagagagaagaggaagaagcagctagaaggcaacaggaggaagaagctgagagagaggcagaagaagcgaggacaagagaagaggaagaggcagctagaaggcagcagggggaagaagcacaaagggaggcagaggaagcaagaaggagagaggaagaagcagcaaggaggagggaggaacaagcgcagagagaggcggaggaagcaagtaggagagaggaggaagcagcagctagaaggagacaggaacgagaggaagcagaaagggaaagacaagcagaggaagccaggagggagggagaggaaacaaggagacatgaagaagaagaagaagaagaagaggaggaggaggaaacaaggagaggagagaggggagaggaggaggaggaaggaggaagaaaagaagaggaggcggcaagagaggccgagaaaagaaggcaagaagaagcccagagacaacaagaagcagctaggagacaggaagaagaaatggaaagaaggcatcaagaagaagaaaccgaggaagaggagcagggtccttacgcacggaggaaaagaacattccttaaaacagcatga

SEQ ID NO: 28 - protein, 734 aa, Artificial Sequence
  Description of Artificial Sequence: Synthetic polypeptide
MSDKKSVSTPFECCRILFKFLLFMVIISNVAIHVTALSGREGITPSTEWGLGPLVKRGERKLVVSTENGEVSSVRVADGITGSYHLQFITLEPNSLFLPVVLHADMVFYVHTGSGRLTWMDETEQKSVDLRIGDVFRLPFGTIFFIESNLEPARQKLRVYSIFTNSGDDLREPLSGPHSSIRDMVLGFDRKVLQAAFHVPEDVIDEVLNGTEVPAIIHGVPKTTKKTLWEMEAQFMKSLLGRGGHGFFDSQSNKKKTELFNIFKEKPDFENCNGWSTVITRKKLPALKGSHIGIYVVNLTKGSMMAPHWNPTATEIGIALQGEGMVRVVCSSTGTKQGCQNMRFKVEEGDVFAVPRFRPMAQMAFNNNSFVFVGFSTTTKRHHPQYLTGKASVLRTLDRQILAASFNVTNTTMDRILEAQGESVILECTSCAEEEVRLMEEERRRAEEEERRREEEEARQREEERRREEEEARRKEEEEARKAEEERRKREAEEARRREEEATREKEEQRRRQEEEARRREEEEARRQEEEIRRRQEEGEARKREEEEAARRQQEEEAEREAEEARTREEEEAARRQQGEEAQREAEEARRREEEAARRREEQAQREAEEASRREEEAAARRRQEREEAERERQAEEARREGEETRRHEEEEEEEEEEEETRRGERGEEEEEGGRKEEEAAREAEKRRQEEAQRQQEAARRQEEEMERRHQEEETEEEEQGPYARRKRTFLKTA

SEQ ID NO: 29 - DNA, 1302 bp, Artificial Sequence
  Description of Artificial Sequence: Synthetic polynucleotide
atgggcgtaccagaatcggaggtggtgtcacaaggtgaggttgaatcaccattgcaaccagatcaaaaccagcacaagaaccatcagttcccgtccctcggtagacaagcatcgatctactccctcactctcgacgaattccaacacaccctatgtgaaagtggcaagaatttcgggtcgatgaatatggatgaattccttaacagcatttggactgctgaagaaaaccaagcccacgcacacgcccatgcccatgccgcgcacgggcatgcgcacgcgcattctcatgctcatagccaagcaccaagtacaggggaagccactagcacaccacattttgcgataggacagagcaatgtttcaatggagaaagctattgccaagcagccaagcttgccaagacagggttctcttacgcttccggaacctttgtgtcggaaaactgtggatgaagtttggtcagaaattcataagagccaaaaagagcaacatcagaataatgggggcagtgtcccggacacgggtaattccgctcaacggcaggttacatttggcgaaatgacacttgaggatttcttggtcaaagcaggggtagtacgcgaacaggagaatgcccctgcacctcctcaacagcaatcatatatgatgtatcaaaacagcaacaatcccgctatggccaatatggctcgacctgttattggcttaggtggagtcacgggcagcgttggagttggcattcctagctatccaccacttcctcagaccggggtggttgaggccccaatatacccggtaagtatgaaaaggggtgccggattcccacaacagccaacggctgtttacggcgggagaatggggaatggtggcggggtcgggtatgggcaagtacaaggagtggccgggatggggtcgccactaagtccagtgtcgtcggatggattatgcgttaatcaagtcgatagcgggggtcaatacgggttggaaatgggaatgagaggaggaagaaaacgcataatagatggtccggtagagaaagtggtggaaaggaggcaaaggagaatgatcaagaatagagaatcagcagcaagatcaagagcaagaaagcaggcttacacagtagaacttgaggcagaactgaaccagctaaaagaagagaatgcacatctgaaacaggccctggcggagctcgagaggaaaaggaaacaacagtactttgacgaagggaaaatgaaagtgcaaacgaaagcgcaaaaggcgactaacaaattgagaggtatgaggaggagtttgagttgcccttga

SEQ ID NO: 30 - protein, 433 aa, Artificial Sequence
  Description of Artificial Sequence: Synthetic polypeptide
MGVPESEVVSQGEVESPLQPDQNQHKNHQFPSLGRQASIYSLTLDEFQHTLCESGKNFGSMNMDEFLNSIWTAEENQAHAHAHAHAAHGHAHAHSHAHSQAPSTGEATSTPHFAIGQSNVSMEKAIAKQPSLPRQGSLTLPEPLCRKTVDEVWSEIHKSQKEQHQNNGGSVPDTGNSAQRQVTFGEMTLEDFLVKAGVVREQENAPAPPQQQSYMMYQNSNNPAMANMARPVIGLGGVTGSVGVGIPSYPPLPQTGVVEAPIYPVSMKRGAGFPQQPTAVYGGRMGNGGGVGYGQVQGVAGMGSPLSPVSSDGLCVNQVDSGGQYGLEMGMRGGRKRIIDGPVEKVVERRQRRMIKNRESAARSRARKQAYTVELEAELNQLKEENAHLKQALAELERKRKQQYFDEGKMKVQTKAQKATNKLRGMRRSLSCP

SEQ ID NO: 31 - DNA, 1266 bp, Artificial Sequence
  Description of Artificial Sequence: Synthetic polynucleotide
atggaggaaaaagatgaacttgaggaagaagaagaatatgttgatgatgaaatcaagaacaatttaccagtccaaaactcatcttcaataagttggttcacaaaaatgatatctttacaagtagagatcttcaccactatcttagtttcccccattttctatatcctctcttttgtatctgacttcaacttcctccgccctgaagaaaccgaaaagaacgtagctgtagctgtaaatgctgctgctacagtaccttcaaaagtagtacatggaagtactttactgctcaagaaatttggtgttggaattcttggagctgcttatgttggaatggttttgacaacgttgttgattttgtcgggggttctgggatttgggttagtgagaatgtgggcggaagagcctgtggtattgagagagaagctgtattttgattatgcagatgtttatcctaaggctgttttttcttttgctgaatatggtctggagaattataaccataattttatgatgttgaagcagaagaagaattttggtgtgccagttgggcatacaatgtatgtttctttgtttctactgatgcctgaatctgatttcaacagagatattggtgttttccagttggttgcagaagcgttatcagccgaggggatcataatggcaagatcaagtcatccacgtatgttgcgattcagaagcctgccaatccgtctcatgcgagaatttattatgagtgtgcccctagtacttggacttacagctgaaacacaaaggatgatcattccaatgttaaagcataaggaaggtattccaagaacagaggcaatcaaaataactatgatacctcgagctggaacgctagccctgccgcagctttatcaatcggagatcatattgaagtctcatcctccttggtataaagacttggcatacaagtggaaatggacattctccgtctggacctctatgtatatgtatgttacactgctcataattctactcaactggtgcagaccgctcgtatttccagtgatcgcaacaagctttaggacacgcgttgatgagagtttaacagtggaagcatcagaagaaccacaagagaaagctcgagaagaaagtgatgtgtcggagtcggtaagaagatggcggcagagcagaagaaagaggaaggcaatgcttcaacagagtgtctcgccagagttcgcggatgattctgcatcaagcatttctgtgactagggaggatacagctgagtcaagcgagtaa

SEQ ID NO: 32 - protein, 421 aa, Artificial Sequence
  Description of Artificial Sequence: Synthetic polypeptide
MEEKDELEEEEEYVDDEIKNNLPVQNSSSISWFTKMISLQVEIFTTILVSPIFYILSFVSDFNFLRPEETEKNVAVAVNAAATVPSKVVHGSTLLLKKFGVGILGAAYVGMVLTTLLILSGVLGFGLVRMWAEEPVVLREKLYFDYADVYPKAVFSFAEYGLENYNHNFMMLKQKKNFGVPVGHTMYVSLFLLMPESDFNRDIGVFQLVAEALSAEGIIMARSSHPRMLRFRSLPIRLMREFIMSVPLVLGLTAETQRMIIPMLKHKEGIPRTEAIKITMIPRAGTLALPQLYQSEIILKSHPPWYKDLAYKWKWTFSVWTSMYMYVTLLIILLNWCRPLVFPVIATSFRTRVDESLTVEASEEPQEKAREESDVSESVRRWRQSRRKRKAMLQQSVSPEFADDSASSISVTREDTAESSE

SEQ ID NO: 33 - DNA, 597 bp, Artificial Sequence
  Description of Artificial Sequence: Synthetic polynucleotide
atgtataactcaagcaactacagctgtaattacaaccccattttctcatctaatttattcaacatcccttctccttgtatgcaatatgaacacgaacttttcttccaatattaccatgatcaacttcaacagaatcttgacgataccttagctgagatcagtactgagactgccattattaacacggcagattccagcaaagacgaggctataatcagtagaaatgaacttgaacaagatcaggaagcgcgtaagaataaaaagggtaaagtaagcagcaacaagagagtgtctaagaaagatagacacagcaagattaacactgctaaaggcccgagagaccgaagaataagactttcaattgatattgctcgcaattttttcaatttacaagacatgttgaggttcgagaaggccagcaaaactctggagtggttgcttataaagtcaaaatctgatatcaaggagctctccaaaagtcgaataagcaaattaagatgtagtactgttatgggtgcaaatagtgaaacctccacttctgaatgtgaagttgtatcaggaattgatgaatctccatccaatcaaggcaaatgctaa

SEQ ID NO: 34 - protein, 198 aa, Artificial Sequence
  Description of Artificial Sequence: Synthetic polypeptide
MYNSSNYSCNYNPIFSSNLFNIPSPCMQYEHELFFQYYHDQLQQNLDDTLAEISTETAIINTADSSKDEAIISRNELEQDQEARKNKKGKVSSNKRVSKKDRHSKINTAKGPRDRRIRLSIDIARNFFNLQDMLRFEKASKTLEWLLIKSKSDIKELSKSRISKLRCSTVMGANSETSTSECEVVSGIDESPSNQGKC

SEQ ID NO: 35 - DNA, 1038 bp, Artificial Sequence
  Description of Artificial Sequence: Synthetic polynucleotide
atgtatccgtcaagcaacatctgtaattacaaccccaatatttcctcctcaaataacttatttcacattccatctcctaattctatgcaatatgaacacgaacttttccaatatttccacgaccatcatctccttcaaccccaacaacaacaactactcttgactacacctgatcattacatggcagcagattccaacaaagataccgtaatcagtagtactattaatcaactggaaggtcctaaagaagttgaattacaaggcagctgcaagaacaaaaatggtgaaaataagagagctgttgcttacaagaaagatagacacagcaagattaatacagctcacggccctagagatcgaagaatgagactttctctcgatgttgctcgcaaatttttcaatttgcaagacttgcttggattcgataaggccagcaaaactgtggagtggttgcttaccaagtccaaatctgctatcaatgagctcgtccaaagtactgctactggtgcaattagtacatcctctacgacatccgagtgtgaagtgatatcaggaattgatgaatctacaaccactaatgatattcagaagcagccaaatagaagtaaagtaggggagaagaaaaaggctaataaactagctcgtagagctgcatttaatcctgtggcaaaggaatcaaggaaacaagctagagcgagggcaagggagagaacaaaaataaagaaaagccttttaaatattggtgatcagtctatggcggctgatgatttaaaacgattaggatgttggagtccttttgaaacaggtgaagaatcaggtattcaaggctatagtactaatcatcaagtagaagaccaacacactacgaaccacgaggagcatcttttggggactaaagagaatgttgatggctgtaatttggttgttactggcaactggaacccatttactatcttcaactatcaccacaatactgaaatttctcacgagcaacaatttacaaacttccagttttctgggaagttttgggaagtttag

SEQ ID NO: 36 - protein, 345 aa, Artificial Sequence
  Description of Artificial Sequence: Synthetic polypeptide
MYPSSNICNYNPNISSSNNLFHIPSPNSMQYEHELFQYFHDHHLLQPQQQQLLLTTPDHYMAADSNKDTVISSTINQLEGPKEVELQGSCKNKNGENKRAVAYKKDRHSKINTAHGPRDRRMRLSLDVARKFFNLQDLLGFDKASKTVEWLLTKSKSAINELVQSTATGAISTSSTTSECEVISGIDESTTTNDIQKQPNRSKVGEKKKANKLARRAAFNPVAKESRKQARARARERTKIKKSLLNIGDQSMAADDLKRLGCWSPFETGEESGIQGYSTNHQVEDQHTTNHEEHLLGTKENVDGCNLVVTGNWNPFTIFNYHHNTEISHEQQFTNFQFSGKFWEV

SEQ ID NO: 37 - DNA, 1014 bp, Artificial Sequence
  Description of Artificial Sequence: Synthetic polynucleotide
atgtatccgccaagcaatagctgcaactacagccccattttcaacatcccttctccttgtatgcaatatggagacgaactattcttccaatattatcatgacgattaccttcaagagcaacaagtaccgttgatagaagatcagagtcttgacatcttagctgagagcactgagactgttactaataacaaagaaaccgtcatcaattctgatcatagtgtaaaagtttataacatagaaactgttacaaacagtcagggtttgggaggaaatgaagaaaaaagagtagaaggccgcgaaaacaaaagagatgatatgagcggcaccattagtatcattcatggacggaaaaacaagaaatgttcccataaagatcgacatagcaagattagcactgctcgtggccttagagatcgaaggatgagactttcccttgatgcagctcgcaagtttttcagtttacaagacatgttggggttcgataaggcaagtaaaactgtagaatggttgcttaccaaatcggagtctgaaatcgaagagctagctaaaggcaataaagaaggagaatcccttcctaaacaaagctgcagtactaccaatggaattggtgcaattagtactgcaatatcctctatttctgagtgtgaggttatatcaggaactgatgaatcttcttctattactgataaaaagaagctggaaactgctaaaggaccgttgaaaaagaagggtaaaactgctcgtagagctacatttgatcctcttattacaagggaatcgaggaatcaagcaagggttagggctagagagcgaacaaaactaaagaaaagccttagtaaatccaaagccatgactcatgagaacagtgctgatgactgtaatttggtggttaattttggagattggagtcaatttagcatcttcaactatcagcaaaatgcagttggaatttcccatgatcagcagcaatttacagacttccaattttgtggtaataagctgtgggaagtctag

SEQ ID NO: 38 - protein, 337 aa, Artificial Sequence
  Description of Artificial Sequence: Synthetic polypeptide
MYPPSNSCNYSPIFNIPSPCMQYGDELFFQYYHDDYLQEQQVPLIEDQSLDILAESTETVTNNKETVINSDHSVKVYNIETVTNSQGLGGNEEKRVEGRENKRDDMSGTISIIHGRKNKKCSHKDRHSKISTARGLRDRRMRLSLDAARKFFSLQDMLGFDKASKTVEWLLTKSESEIEELAKGNKEGESLPKQSCSTTNGIGAISTAISSISECEVISGTDESSSITDKKKLETAKGPLKKKGKTARRATFDPLITRESRNQARVRARERTKLKKSLSKSKAMTHENSADDCNLVVNFGDWSQFSIFNYQQNAVGISHDQQQFTDFQFCGNKLWEV

SEQ ID NO: 39 - DNA, 867 bp, Artificial Sequence
  Description of Artificial Sequence: Synthetic polynucleotide
atgggcctctcacaatatccagctccagcagatgcaggagtactgtgtgtgattcttgtaaacacagccatatctatttccattgtcaaggagatagtccgatcgatccttcacgttattggcatccatatcgcatcatgggaagattattcttttgaaggatcatttgaatgccgcggaagcccatcagagtcatacatggaggagtttagaagccgaacacctgcatttcgttatgactcggtgtgtatctctaaccaccctgagcaagaatgctctgtgtgcctgactaaattcgagcctgacacagagataaaccgtctctcctgtggccatgttttccataagctgtgtctagagaagtggctcaagtattggcatgtaacttgccctctttgcaggaaacacatgatgcctcacgagcaagaggacgatacatgtccaatgtcattttccagctatgttgcgcgaactctccaaaatgctaccgcatttatgttggatcctccaaaaatgcactacttttggaggatccgacatgtgcctgatgacattttcggagaatctgagcaacattgctttccagtagccaactcagagagtttcgagccaactgacatgctagtgcgagtcaacgcagggttcctgtggtatctgcacctgaaagaacctgcatgtgtagttggtgagcacaagcagctgtaccttacacttgatgtctttcgcaatgctgacggtgaagaaggcgtcgaggatggtaatggtgccatagttggttgtggttgttcagccatccttcagcagattctgcagaagaaattaatagatatgaacaagaaattctggattgactatgaggtagagtag

SEQ ID NO: 40 - protein, 288 aa, Artificial Sequence
  Description of Artificial Sequence: Synthetic polypeptide
MGLSQYPAPADAGVLCVILVNTAISISIVKEIVRSILHVIGIHIASWEDYSFEGSFECRGSPSESYMEEFRSRTPAFRYDSVCISNHPEQECSVCLTKFEPDTEINRLSCGHVFHKLCLEKWLKYWHVTCPLCRKHMMPHEQEDDTCPMSFSSYVARTLQNATAFMLDPPKMHYFWRIRHVPDDIFGESEQHCFPVANSESFEPTDMLVRVNAGFLWYLHLKEPACVVGEHKQLYLTLDVFRNADGEEGVEDGNGAIVGCGCSAILQQILQKKLIDMNKKFWIDYEVE

SEQ ID NO: 41 - DNA, 2562 bp, Artificial Sequence
  Description of Artificial Sequence: Synthetic polynucleotide
atgaatcttcaggtggatgatcaaatgatactcatttctcagtactatcctggtatctacactcaagagttaccagaacaaggggaggcgaaacaaaggaggagacgaaagaagaacaaaggagaagcaagtgaggttatgaggaaaagaaagcttagtgaagaacaagtgaatctgcttgaacagagctttgggaaagagcacaaactggagtccgagaggaaagacaagcttgcctctgagctggggcttgatcctaggcaagttgctgtctggtttcagaacagaagggctagatggaagaacaagaagttggaggaggaatactctaagttgaagtctgagcatgacactaacattgttcataattgccgtcttgaaaatgaggttttgaagctgaaggaacagttgtctgaagcagagaaagagatacaaaggttgctgatggagagatgtgatggggttaattcgagcaatagcccaactacttcatcactctcaatggaagcagccaatatggaacctccttttcttggggaatttggaatggaaggatttgacaatacattttatgtgccagaaaacacttactctcagggattggaatggaatggaccattttttgcacctcctgatattgattatgggatcattaggttccagacattacccgaccccactattcctgggcagtatgcgaactacacatggggtagtgaatcttatacacaattgcttcagtccgttaggcacaagctcaacccttctgttcatttttatgtcattcgaggcattgcactagctatgcaaatatggttgtatgagtgttgctctaccgtcaacactgatatagctacaaggatttctaattcaatctctcgcatacttagctggtcagctagtaaggacaagatatggttatctgcaattgaagatagaatgatcaaaccatcatggatcaagttcaccaacataattgaagcaccagaggagctttcaagaatgaatttgccaaataaagttgaatacattcttgaagaagttgaaacaaagtccgagcatccgatagatgctccatctccatccgttggttcagatcttggaactttcaagaaagaggtttttgaagaactagatacagggcaggtgaatgatataaaaattatggagaatgttcctgtaggtgttgatttatcttcccaatttgaaggggcatttgatgaagagaatgcagagaaggaaactatgcatgtagaatctccaaaacagaaagctacaataagcattccaggaaaacaaaaaaatgaggagaaggagacaaaaatacaatctcacattcaagaagagaacgttatacaacaaggagatgattgttgtgaagatttcagtggtgaatcagccgactacattaatataggtgattcagacaatgactctagatctgaaaaaagagaagtaacacttgatgattttgagctgccagagaacttctcccagattattaattctggggggagaacttctgttggacctccaattttcctcatcaagcatccatttactggggttattggcgaagatgttgatcctgacttattggaagaattcaataagtggttatactttggtatcgatacagtttcaaagaggaggaaggcgccttattctgtaaaagataaccagcttaagccgtggtatgattttggagtggagaaagttgataaaaatgagaggttttatactttggtacaccccgggcaagtcctcaacgatacgcacattgatgttattttatactatttgagaaagagaggaaagtatggtcgtcaaaacaaaatatggtttacaatcattgattgtatgttcaacactagaattgaacaaatttatcagaggtacatcaatactcctgccgataagaagcttgttgttgtcaaatcccaagacgtcgtatcagaatacatattggggtacagattactcgcaaatattgcattggatcaagttgattttgtgattatgcccataaacattgtgaaaaaattttattggttgttggttgtgtttgacattaccgatagggttctatatgtttatgattctatgttctcttcacgaaatcacaaccttgttgaatttgttgtcaacaagtttgctgttatgatccccctctacttgtcatgcaccgacttctatggcaagcgtccagacatcaactacaagaacacaaaagcatacattgaaaaatgtgttactgaccctcttgacattcagtggttggtcggtgagatactccatcaaaatgagggatcacttgactgtagtgtatacgtggctgcatttacagaatatgtcagcattggagagctagcagtttcaaaggaagacctttctgatattgatcaacatcgtagacgctatggagcgctactttgggattatgataggaagaagcaagatactggtgcaattagtgagagcgaggtgactggcagattagcaagaagaaaaggtgcaccagctgtgaacgagagaacacaagtccggaagaagaagaattag

SEQ ID NO: 42 - protein, 853 aa, Artificial Sequence
  Description of Artificial Sequence: Synthetic polypeptide
MNLQVDDQMILISQYYPGIYTQELPEQGEAKQRRRRKKNKGEASEVMRKRKLSEEQVNLLEQSFGKEHKLESERKDKLASELGLDPRQVAVWFQNRRARWKNKKLEEEYSKLKSEHDTNIVHNCRLENEVLKLKEQLSEAEKEIQRLLMERCDGVNSSNSPTTSSLSMEAANMEPPFLGEFGMEGFDNTFYVPENTYSQGLEWNGPFFAPPDIDYGIIRFQTLPDPTIPGQYANYTWGSESYTQLLQSVRHKLNPSVHFYVIRGIALAMQIWLYECCSTVNTDIATRISNSISRILSWSASKDKIWLSAIEDRMIKPSWIKFTNIIEAPEELSRMNLPNKVEYILEEVETKSEHPIDAPSPSVGSDLGTFKKEVFEELDTGQVNDIKIMENVPVGVDLSSQFEGAFDEENAEKETMHVESPKQKATISIPGKQKNEEKETKIQSHIQEENVIQQGDDCCEDFSGESADYINIGDSDNDSRSEKREVTLDDFELPENFSQIINSGGRTSVGPPIFLIKHPFTGVIGEDVDPDLLEEFNKWLYFGIDTVSKRRKAPYSVKDNQLKPWYDFGVEKVDKNERFYTLVHPGQVLNDTHIDVILYYLRKRGKYGRQNKIWFTIIDCMFNTRIEQIYQRYINTPADKKLVVVKSQDVVSEYILGYRLLANIALDQVDFVIMPINIVKKFYWLLVVFDITDRVLYVYDSMFSSRNHNLVEFVVNKFAVMIPLYLSCTDFYGKRPDINYKNTKAYIEKCVTDPLDIQWLVGEILHQNEGSLDCSVYVAAFTEYVSIGELAVSKEDLSDIDQHRRRYGALLWDYDRKKQDTGAISESEVTGRLARRKGAPAVNERTQVRKKKN

SEQ ID NO: 43 - DNA, 2790 bp, Artificial Sequence
  Description of Artificial Sequence: Synthetic polynucleotide
atgatagtagtaagatggtggatgacaacattccaattgacagagctgtttgtgagttgtttagttcatttgacttacgggctttacatattcagcacagcagtggccggtgatgtttcccagactctgagcgattggcttttcaagccaaatttggaaactagccttaaaacagatgattcaaaaaagactaacactgatttgcctcctattgtgttggttcatggaatctttggttttggcaaagggagattgggaggactttcatatttcgctggtgcagagaaaaaggatgaaagggttctagtaccggatttgggttcacttactagcatttatgacagggcacgtgaattgttttattatttgaaaggagggcaggttgattatggggaggaacacagtaaggcttgtgggcattcccaatttggacgaatttatgaacaaggacactaccccgagtgggatgaagatcatcctattcattttgtgggccattcagctggagcacaggttgttcgagtcttgcaacagatgctggctgacaaggcattcaaaggttacgacaacacttcagagaactgggtgttaagcctaacatcattatctggagcacttaacgggacaacccgaacttactttgatggaatgcaacctgaagatgggaagtccttaacgcccgtatgtttgctccaactttgccgcattggagtaataatttatgagtggcttgacattcccttgctgaaggactattacaactttggctttgaccacttcagtatgtcctggaggaaaagtggtatccggggttttgttgattgccttttagggaatggcggtccatttgcttcgggagattggatacttccagatcttactatccaggggtcaatgaagttgaacagccacttacgtacatttccgcaaacatactacttcagctatgctaccaagcgtaccacacaagtaatgggtcttacagttccttctggcgttctagggatacatccgctgctattcatcagagtcctgcaaatgagccaatggcggcatccacaagatgtttctcctccgtacaagggctatagggatgaagattggtgggacaatgacggtgctctcaacaccatatctatgacgcacccacgcttgccggttgaacacccgagtcaccttgtcgttaaagattctgattgtcagcccttgcaacctggcatctggaatcatcaagtttcctcttctgtgcagttgttatcaccaccattggctcgtaggctttccgtggggaaatgtgaaagggaaatatctgtcattctcagttatgttacggaaagatcagctctcaccattagaaaccccgatggaagccaacaacaaaccaccaagatcctctttcaccaccagaagtgcgcatgccttccgtcttactgtgaacgcccacgtccaatggaatttctgggaaggatttcaagaaatgtagaaggaaatgatactaaggctaggatttctgcagctattttactagtttgcattatccttcctttgctagcctcagcatttcttgatcatcttcctgaatttctagaacatgattctagaaataaagatgtaacaatccgtggtgataataatattgttcgtgccaatgacaatgactttactcttcctcgctcacatgagaaaaagaatgaaagatctttaagagaaaagaagtcaaagaagaagaagcataagaagaagaagaacaagaagggaaagaaatcacacaaagataaaatttttgattttgaccatatttttggaggaaaccaacaagaaggagatgaattttccccttatttgcaaccatttgatgtgcctcaaacaacagaagaacaagaacagaccgagaattatgatggattacgtgagggattttaccagaaaacatgtcctcaagcagagaatattataagaaatggtctaatcagggcctttcagaatgactctaccattgctgctgcattacctcgccttctcttgcatgattgctttgtcaatggatgtgatgggtcgatattactagatacaacacccagtggtgcaagagtggagaagttagcaggcacaaatggtgctacagtcaagggatttgaactcatagacgagatcaaagccgagctcgagagacaatgccctggcattgtctcctgctctgatattttggcatacttgtcgcgcgatgcctttgttttatcaggcctccccaattacaacgtgctaggtggtcgacgcgatggcatggaatccaatgaagcaaacgttgttggaaacctaccacttcctggcgacacagtggatcaaatgattgatctttttcaaaagaaaggcctaaattcggaagatttggttgtcctaattggtgcacattcaattggagtagcccattgtttcaacttcctttacagattggacgaaccagagaaggcacaaatgttagatccaaggcttgctggagtcatgagatttatttgtactaaccaaatgaataccttaccttttgatcccacaacacagtacaagatggattcaattttctacaagcaactaatgatgaagaaagggttgattgaatcggatcaaatactggctcaagatattagaacgaggggcttggtgcaaaagtttggtgatgatgaaatgggatggtttgataagtttggtaaggctatgaataaattgggagcaattgaagtgctcactggaaaccaaggccagatcaggagacagtgtagagctgttaactga

SEQ ID NO: 44 - protein, 929 aa, Artificial Sequence
  Description of Artificial Sequence: Synthetic polypeptide
MIVVRWWMTTFQLTELFVSCLVHLTYGLYIFSTAVAGDVSQTLSDWLFKPNLETSLKTDDSKKTNTDLPPIVLVHGIFGFGKGRLGGLSYFAGAEKKDERVLVPDLGSLTSIYDRARELFYYLKGGQVDYGEEHSKACGHSQFGRIYEQGHYPEWDEDHPIHFVGHSAGAQVVRVLQQMLADKAFKGYDNTSENWVLSLTSLSGALNGTTRTYFDGMQPEDGKSLTPVCLLQLCRIGVIIYEWLDIPLLKDYYNFGFDHFSMSWRKSGIRGFVDCLLGNGGPFASGDWILPDLTIQGSMKLNSHLRTFPQTYYFSYATKRTTQVMGLTVPSGVLGIHPLLFIRVLQMSQWRHPQDVSPPYKGYRDEDWWDNDGALNTISMTHPRLPVEHPSHLVVKDSDCQPLQPGIWNHQVSSSVQLLSPPLARRLSVGKCEREISVILSYVTERSALTIRNPDGSQQQTTKILFHHQKCACLPSYCERPRPMEFLGRISRNVEGNDTKARISAAILLVCIILPLLASAFLDHLPEFLEHDSRNKDVTIRGDNNIVRANDNDFTLPRSHEKKNERSLREKKSKKKKHKKKKNKKGKKSHKDKIFDFDHIFGGNQQEGDEFSPYLQPFDVPQTTEEQEQTENYDGLREGFYQKTCPQAENIIRNGLIRAFQNDSTIAAALPRLLLHDCFVNGCDGSILLDTTPSGARVEKLAGTNGATVKGFELIDEIKAELERQCPGIVSCSDILAYLSRDAFVLSGLPNYNVLGGRRDGMESNEANVVGNLPLPGDTVDQMIDLFQKKGLNSEDLVVLIGAHSIGVAHCFNFLYRLDEPEKAQMLDPRLAGVMRFICTNQMNTLPFDPTTQYKMDSIFYKQLMMKKGLIESDQILAQDIRTRGLVQKFGDDEMGWFDKFGKAMNKLGAIEVLTGNQGQIRRQCRAVN

SEQ ID NO: 45 - DNA, 2478 bp, Artificial Sequence
  Description of Artificial Sequence: Synthetic polynucleotide
gtatgtttcagtctcacagagatcgttcatcgataccacagccatgtggaagcagaaaaagagagctctgcagaagttttggacaccgagcactctaaatatgcaagcttcatgacagtgggacaactgttacaaacggtaggaaggcaactcgaggaacctgctgttgatgatctcagtgtaactgaccttgtccatttggaaaaccaactgccaactgctctaatgcaagtcagatctagcaagacgcatttgatgattgaatctatcaaaagtcttcgtgagaaggaaaaactgctgagtgaagaaaacaaacatctggagaacaagtacactccagcttacaacttcaaatcagcaatggctctacctatcgacctcgaagccggccttcaagatgaaaccaacaacttggcgcccggggccggaaggctacctgacgacggcaacgaggctcgaatcgaagaacccgaaattcgagccgaagtaccattggatatcaattcacaaatagctctagaagcgaatcagcgttctgaaccggaaagaagcgttcagggcggtgctcgacccatagcccgagacacctacagcacgggggaaatcggggtcagcttgcgtatgattttcgaaatgttacaagcccaacaagcagcgatagctcagttgcagagccgaactcatatgcaaagcgggccgaactccaatccgcttcttcgagaagtcacccccagaacggagcccgccgtagtgaaatcaaacgagcaggaatcggggaccgctcctgaaattgctaaattgctcgaggaactcacaaaacgagtcgaagccaacgacaaaaaagtggaaacgtataacgctagggtcgatcaaatcccgggggctccgccaatgataaaagggctcgattcgaaaaaattcatacaaaagccttttccctcgagcgcggccccaaaaccaatccccaaaaaattccgtatgcccgaaattcccaaatataacggtacgaccgatcctaacgaacatgtcacctcctacacatgtgccatcaaaggcaacgatttggaggacgatgagatcgaatccgtgttgttgaaaaagttcggagagaccctcgcaaagggagcaatgatctggtatcacaacttaccaccaaattccattgattcttttgccatgttagcagattcgttcgtaaaagcacatgctggtgccataaaggttgcaacaaggaaatcagacctcttcaaagtaaaacaaaggggtaacgaaatgctgagggaattcgtatcccgatttcaaatggaacgtatggacttgccaccggtcacagacgattgggccgtacaagctttcacccaaggactgaacgggctaagttcgacagcatcacatcggatgaacaacggttcagcacgtgatacggttcggaacaaccgaaggactgatcgggggcaaaattctcggggacttatgagcaagagcggctttgataaatatgccgatcctatagaagtccctcgattatcggagtataacttcaacattgatacatccgccatcgtatcggccatcggacgcatcaaagacaccagatggcctcgacccatgcagaccgatcctgcccaaaggaatcccaatcaaatgtgcgaatatcatggcacccatggccacagaacggaagattgcaggcaactaagagaggaagtggcccgcttatttaacaaaggacaccttcgggaatttctgagtgatagggcgaagaaccattttaggaacaaggaattcggcaagcaaaacgagccagaagaaccgcaacacgtcattcacatgatcatcggcggcgtcgatgcccctcagggaccgatgcttaaacgcactaaaacatcgattgtgagggaaaagcgatctcgaactcaagattatacacccatagggactttgtccttcagtgatgaagatacagagggaatcatccaaccccataacgatgcactggtaatatccgtactcatgaataaaactaagattaagcgtgtgttaattgatccaggtagctcggccaatatcatcagatcgagggtcgtagaacagctcggcctgcaagatcaggtcgtacccgcaactctggttctaaacggattcaatatggcatgtgaaaccaccaaaggcgagattaccctaccgataaacgtggccggaaccatccaggaaacaaagtttcacgtgatcgaaggtgatatgagatataacgcccttttcggaaggccgtggatccacagcatgagagccgtaccctcgaccctacaccaggtcctcaaattcccaacatcgggaggtgtcaaaatagtgtacggagaacaaccggccgcaaaggaaatgttctccgtcgaagaagcaaaatcaatatcctcgtcttcgccgataaaaggatcaggttcagaaggagacacaatcggagagcagagcgccaaatag

SEQ ID NO: 46 - protein, 825 aa, Artificial Sequence
  Description of Artificial Sequence: Synthetic polypeptide
VCFSLTEIVHRYHSHVEAEKESSAEVLDTEHSKYASFMTVGQLLQTVGRQLEEPAVDDLSVTDLVHLENQLPTALMQVRSSKTHLMIESIKSLREKEKLLSEENKHLENKYTPAYNFKSAMALPIDLEAGLQDETNNLAPGAGRLPDDGNEARIEEPEIRAEVPLDINSQIALEANQRSEPERSVQGGARPIARDTYSTGEIGVSLRMIFEMLQAQQAAIAQLQSRTHMQSGPNSNPLLREVTPRTEPAVVKSNEQESGTAPEIAKLLEELTKRVEANDKKVETYNARVDQIPGAPPMIKGLDSKKFIQKPFPSSAAPKPIPKKFRMPEIPKYNGTTDPNEHVTSYTCAIKGNDLEDDEIESVLLKKFGETLAKGAMIWYHNLPPNSIDSFAMLADSFVKAHAGAIKVATRKSDLFKVKQRGNEMLREFVSRFQMERMDLPPVTDDWAVQAFTQGLNGLSSTASHRMNNGSARDTVRNNRRTDRGQNSRGLMSKSGFDKYADPIEVPRLSEYNFNIDTSAIVSAIGRIKDTRWPRPMQTDPAQRNPNQMCEYHGTHGHRTEDCRQLREEVARLFNKGHLREFLSDRAKNHFRNKEFGKQNEPEEPQHVIHMIIGGVDAPQGPMLKRTKTSIVREKRSRTQDYTPIGTLSFSDEDTEGIIQPHNDALVISVLMNKTKIKRVLIDPGSSANIIRSRVVEQLGLQDQVVPATLVLNGFNMACETTKGEITLPINVAGTIQETKFHVIEGDMRYNALFGRPWIHSMRAVPSTLHQVLKFPTSGGVKIVYGEQPAAKEMFSVEEAKSISSSSPIKGSGSEGDTIGEQSAK

SEQ ID NO: 47 - DNA, 1152 bp, Artificial Sequence
  Description of Artificial Sequence: Synthetic polynucleotide
atgcagtctgtactctggaacctaaggaagattgaaattcaagataaattctgcgatattgaaaggataagtcctgcatacctcaacacaaatgacacggcaaagaaaattcaagaagaaatcaatggcttgcattgtaaactggaggaggctgagggattattaagaatatttgaaccagatacaaaaaaaattacatcactccatgagcttgatttgtgtgaaaaacgtcttcaggttgccttgaaccaagttaggcaaagaatggaacaactctccaacaatcataatacatcaagttatgaagataatatggagcaaataaatgcactccttcaatacatagacaacacacaaactgaggacacaaaaccctcgttggaggaatctccctatgacttatggctagagcttgaagattatagttacacaaactatattaatgacaacaacaatagtcatctctatgctgcctcagaaacatcttctcttactcaaagttctatgagcctttcttctccaattatttatgatgcaatatcccaaacaagtataagtggtgtgactaattatcataaagaagggacttttagttctttaactgatgagaattttaagcaatcacaacattcaaccagaaccttcccaactctcactttacaaacttcattcaaatttgccaagcctgaaatggaaactcccacatctgcactacggccggtagcgccatatctgcatgttgaagcaacagcagcgtgtagccagcaaccagtttcaagtgattattataaagagaacaatgaactcgactgcagatttcaacctaaagttacaacgtctaactatcaaatgtcccaaaaacgtactgcagaaggaagttttagttccttaactgatgaaagctttaagcaatcacaatgttcaaccaggatcttcccacctatcgctccattacaaacttcattctcatttgccacgcctgaaatggaaactccaacctcagcattgcggccggtggcaccatatctgcaggctgaagcagcagcatcctctaaccagcagctaccttctaataatattgaagaagagaaccatgaaatctcttggtttcagcctcaaatgaaaaagtcgaagtatcatcatttagcttga

SEQ ID NO: 48 - protein, 383 aa, Artificial Sequence
  Description of Artificial Sequence: Synthetic polypeptide
MQSVLWNLRKIEIQDKFCDIERISPAYLNTNDTAKKIQEEINGLHCKLEEAEGLLRIFEPDTKKITSLHELDLCEKRLQVALNQVRQRMEQLSNNHNTSSYEDNMEQINALLQYIDNTQTEDTKPSLEESPYDLWLELEDYSYTNYINDNNNSHLYAASETSSLTQSSMSLSSPIIYDAISQTSISGVTNYHKEGTFSSLTDENFKQSQHSTRTFPTLTLQTSFKFAKPEMETPTSALRPVAPYLHVEATAACSQQPVSSDYYKENNELDCRFQPKVTTSNYQMSQKRTAEGSFSSLTDESFKQSQCSTRIFPPIAPLQTSFSFATPEMETPTSALRPVAPYLQAEAAASSNQQLPSNNIEEENHEISWFQPQMKKSKYHHLA

SEQ ID NO: 49 - DNA, 813 bp, Artificial Sequence
  Description of Artificial Sequence: Synthetic polynucleotide
atgggaactggtacttatggagaagtgggacgtacaatacatcaaagatcaggaacacatatacctcaaattctcgatccgcctttgctaggggatagtgattgcaagcgagaaggcaaacatgtagaatttatgcctccaatcatgggtgaaaacttaaaagcagctaatcaatttgaactgatggccccgtcaattgcattcaaatcatatccctattcggaggtaccacaatattctggtggcaatgtggctgctgcatgtggtgaatctttggtacatcaaaatatagaaagatcagtgcataatggtagaatgattttgccaattgaagtgaaggaggagcctatgtatgtaaatgccaaacaataccatggaattctaaggcgaaggcaacttcgtgcaaaggctgtgttggagcaaaaagtggttaaatctagaaagccttatcttcatgaatctcggcaccggcatgcgatgagaagagctagagatggtggaggccgatttctcaacacaaaaaagaagatccaacttcctgctaataataatattaatacaactactccaagtagtaaaggcaaaggttgtgcagcctcggaagtcagttccatggactctgatttctctcaaaattacttgctcaattctggacatattggatcatccaatgctacttctgttgaaggattccagttccaaggaatacataatacagataatcctcaattgggttgtcattatcagtggaatctcaatgacaaccattgctattgcatgcagtcaggagcttctaatctccaaccattttga

SEQ ID NO: 50 - protein, 270 aa, Artificial Sequence
  Description of Artificial Sequence: Synthetic polypeptide
MGTGTYGEVGRTIHQRSGTHIPQILDPPLLGDSDCKREGKHVEFMPPIMGENLKAANQFELMAPSIAFKSYPYSEVPQYSGGNVAAACGESLVHQNIERSVHNGRMILPIEVKEEPMYVNAKQYHGILRRRQLRAKAVLEQKVVKSRKPYLHESRHRHAMRRARDGGGRFLNTKKKIQLPANNNINTTTPSSKGKGCAASEVSSMDSDFSQNYLLNSGHIGSSNATSVEGFQFQGIHNTDNPQLGCHYQWNLNDNHCYCMQSGASNLQPF

SEQ ID NO: 51 - DNA, 762 bp, Artificial Sequence
  Description of Artificial Sequence: Synthetic polynucleotide
atgggagctggtgcttttggagaagccggacgtacaatatatcaaaagtccgatagtgattgcaagcgagatggcaaacgtgtagaatttatgcctccaatcatgggtgaaaacttaagagcagctaatcaatttgaactgatgcccccctcaattgcattcagatcatatccctattcagaagtaccacaatattctggtggcaatgtggctgctgcatttggcgaatctacggtacatcaaaatatagaaagatcagtgcataatggtagaatgattttgccacttgaagtgaaggaggagcctatgtatgtaaatgccaaacaataccatggaattctaaggcgaaggcaactccgtgcaaaggctgtgttggagcaaaaggtggtcaaatctagaaagccttatcttcatgaatctcggcaccggcatgcgatgagaagagctagagatggtggcggccgatttctcaacacaaagaagaagatccaacttactactaataataataataataatgggaatactaatgcaactccaagtagtaaaggcaaaggttcttcagcctcagaagtcagttccatggactcttattctggacatattggatcatccaatagtactgctcatgtccagggatttcagttccaaggaatacataatacagaaaatcctcaactgggttgtcattatcagtggaatctcaatgataaccattgcaattgcatgcagtcaggagcttctaatatccaaccattttga

SEQ ID NO: 52 - protein, 253 aa, Artificial Sequence
  Description of Artificial Sequence: Synthetic polypeptide
MGAGAFGEAGRTIYQKSDSDCKRDGKRVEFMPPIMGENLRAANQFELMPPSIAFRSYPYSEVPQYSGGNVAAAFGESTVHQNIERSVHNGRMILPLEVKEEPMYVNAKQYHGILRRRQLRAKAVLEQKVVKSRKPYLHESRHRHAMRRARDGGGRFLNTKKKIQLTTNNNNNNGNTNATPSSKGKGSSASEVSSMDSYSGHIGSSNSTAHVQGFQFQGIHNTENPQLGCHYQWNLNDNHCNCMQSGASNIQPF

SEQ ID NO: 53 - DNA, 753 bp, Artificial Sequence
  Description of Artificial Sequence: Synthetic polynucleotide
atgcaatatgaacacgaatttttcttccaatattaccatgatcaacttcaacagaatcttgatgataccttagctgagatcagtactgagactgccattattaacacggcagattccaacaaagacgacgctttaataagtagaaatgaacttgaacaagaggaaggatgtgagaataaaaagggtaaaataagcagcaacaagagagtgtctaagaaagatagacacagtgcaaatagtgaatcctctacttctgaatgtgaagttgtatcagaaattgatgaatctccatctaatcataaggcaaatgctaaaggaaattcttgcaacaaggagaaggagaagaagaagaaggagaaggagaaatcagttcgtcgagctgcattttatcatccatttgcaaaagaatcaaggaaacaagcaagagagagggcaagggagagaacaaaactaaagaaaaacttttgtaaatctcatcatttgaacttaagatcttggaatttctccgaagggggcgaagaatcagcgggatatattagcatgaatcttccttgtcaagaaatgcaagctgaaatagttgaagaactcacctcccacaatgagaagcagcttttattagggattaaagaaaacattgctaatgattgtaatttggtggctactggcaattggagcccaaatgccattttcaactatcaacaaaatgctggaattcctcatgagcatcaaattacagacattccgttttcatga

SEQ ID NO: 54 - protein, 250 aa, Artificial Sequence
  Description of Artificial Sequence: Synthetic polypeptide
MQYEHEFFFQYYHDQLQQNLDDTLAEISTETAIINTADSNKDDALISRNELEQEEGCENKKGKISSNKRVSKKDRHSANSESSTSECEVVSEIDESPSNHKANAKGNSCNKEKEKKKKEKEKSVRRAAFYHPFAKESRKQARERARERTKLKKNFCKSHHLNLRSWNFSEGGEESAGYISMNLPCQEMQAEIVEELTSHNEKQLLLGIKENIANDCNLVATGNWSPNAIFNYQQNAGIPHEHQITDIPFS

SEQ ID NO: 55 - DNA, 1422 bp, Artificial Sequence
  Description of Artificial Sequence: Synthetic polynucleotide
atgatgaagcatatagtacatctgggctccacctcaaatcttacagtagcagctagaggccatggtcactcgcttcaaggacaagctctagctcatcaaggtgttgtcatcaaaatggagtcacttcgaagtcctgatatcaggatttataaggggaagcaaccatatgttgatgtctcaggtggtgaaatatggataaacattctacgcgagactctaaaatacggtctttcaccaaagtcctggacagactaccttcatttgaccgttggaggtacactatctaatgctggaatcagcggtcaagcattcaagcatggaccccaaatcaacaacgtctaccagctagagattgttacagggaaaggagaagtcgtaacctgttctgagaagcggaattctgaacttttcttcagtgttcttggcgggcttggacagtttggcataatcacccgggcacggatctctcttgaaccagcaccgcatatggttaaatggatcagggtactctactctgacttttctgcattttcaagggaccaagaatatctgatttcgaaggagaaaacttttgattacgttgaaggatttgtgataatcaatagaacagaccttctcaataattggcgatcgtcattcagtcccaacgattccacacaggcaagcagattcaagtcagatgggaaaactctttattgcctagaagtggtcaaatatttcaacccagaagaagctagctctatggatcaggaaactggcaagttactttcagagttaaattatattccatccactttgttttcatctgaagtgccatatatcgagtttctggatcgcgtgcatatcgcagagagaaaactaagagcaaagggtttatgggaggttccacatccctggctgaatctcctgattcctaagagcagcatataccaatttgctacagaagttttcaacaacattctcacaagcaacaacaacggtcctatccttatttatccagtcaatcaatccaagtggaagaaacatacatctttgataactccaaatgaagatatattctatctcgtagcctttctcccctctgcagtgccaaattcctcagggaaaaacgatctagagtaccttttgaaacaaaaccaaagagttatgaacttctgcgcagcagcaaacctcaacgtgaagcagtatttgccccattatgaaactcaaaaagagtggaaatcacactttggcaaaagatgggaaacatttgcacagaggaaacaagcctacgaccctctagcgattctagcacctggccaaagaatattccaaaagacaacaggaaaattatctcccatccaactcgcaaagtcaaaggcaacaggaagtcctcaaaggtaccattacgcatcaatactgccgaaacctagaactgtataa

SEQ ID NO: 56 - protein, 473 aa, Artificial Sequence
  Description of Artificial Sequence: Synthetic polypeptide
MMKHIVHLGSTSNLTVAARGHGHSLQGQALAHQGVVIKMESLRSPDIRIYKGKQPYVDVSGGEIWINILRETLKYGLSPKSWTDYLHLTVGGTLSNAGISGQAFKHGPQINNVYQLEIVTGKGEVVTCSEKRNSELFFSVLGGLGQFGIITRARISLEPAPHMVKWIRVLYSDFSAFSRDQEYLISKEKTFDYVEGFVIINRTDLLNNWRSSFSPNDSTQASRFKSDGKTLYCLEVVKYFNPEEASSMDQETGKLLSELNYIPSTLFSSEVPYIEFLDRVHIAERKLRAKGLWEVPHPWLNLLIPKSSIYQFATEVFNNILTSNNNGPILIYPVNQSKWKKHTSLITPNEDIFYLVAFLPSAVPNSSGKNDLEYLLKQNQRVMNFCAAANLNVKQYLPHYETQKEWKSHFGKRWETFAQRKQAYDPLAILAPGQRIFQKTTGKLSPIQLAKSKATGSPQRYHYASILPKPRTV

SEQ ID NO: 57 - DNA, 1659 bp, Artificial Sequence
  Description of Artificial Sequence: Synthetic polynucleotide
atgaagtcaccaccaactcatgtcttctttaaacataaaagtatgcttcttaggttgcttatattcatactaggcatttgctcaataaacagaactaacctttgttgtgaccaaccttttgccaccccaatatcttcttcttcttctaccccttcaagtttttcagtgattcaatcatcattgaaacagttaaatattgaagggtattttagtttcaagaatttcgatcacgcggccaaagactttggcaacagatatcacttcttgccatcggcagttctgtatccaaaatcagtttctgatatatcatctaccataaaacatgtttttgacatgggtgttactacagacctaactgttgctgctagaggccatggccattctttagaaggccaagctcaagcttaccaaggagtagtgatcaatatggaatcgcttcgagcgccagcaatgcgtttccacacagggaatcaagaactgccttttgttgatgtctctgcaggagaactttggataaacatcctgcatgaaagtcttaaacttggattaacaccaaaatcttggactgattatcttcacctcaccgttggagggactttgtcgaatgccggaatcagtggtcaagcattcaaacatggaccacagatcaataatgtttaccaacttgaggttgtcactggtaaaggagaggtgattacttgttcagaggagaagaatgctgacctgttctatggtgtattaggaggactaggccagtttggtatcatcacaagggctagaattgctcttgaaccagcacctaaaaaggtaaagtggatcagagtgctgtattcagatttctccacattttcctatgatcaagaacacttgatatcatccgagaactcttttgactatatagaaggatttgtcattatcaatagaacaggattgttaaacaactggaggtctactttcaatcctaaagatccacttctagccaaagagttcagttctgagggaaaagttctgtactgcctagaagttgccaaatacttcaatccagaagagacaaccaaaactgatcagaatgttgatgttcttttatcaaagttgaattatatccaatcgacgctgttccaatcagaagtatcctacgtggatttcctcgacagagttcacgtatccgagatgaaacttcaagagaaggggttatgggatattcctcatccatggctaaaccttctaattccaaagagcaagattcatgactttgcacgagaagtttttgggaagatacttaccgacactagccacggtcctatactcatctacccagtcaacaaatcaaagtggagaaaaggaacatcagtagttacacctgaagaagatgttatgtatctaatagcatttctatcttctgccatgccatcttcaacaggaaaggacggcgtagaatatattctaaataagaataagaagatactaaacttttgcagaaaagcacatattggaatgaaacagtatttgccacactacacaacgcaggaagactggaaaggtcactttggtccccagtgggaaacatttaaaaggaggaaatctacatatgaccctttggctatcctagctcctggccagagaatttttagaagagcatcaggcgttcaacaacaatga

SEQ ID NO: 58 - protein, 552 aa, Artificial Sequence
  Description of Artificial Sequence: Synthetic polypeptide
MKSPPTHVFFKHKSMLLRLLIFILGICSINRTNLCCDQPFATPISSSSSTPSSFSVIQSSLKQLNIEGYFSFKNFDHAAKDFGNRYHFLPSAVLYPKSVSDISSTIKHVFDMGVTTDLTVAARGHGHSLEGQAQAYQGVVINMESLRAPAMRFHTGNQELPFVDVSAGELWINILHESLKLGLTPKSWTDYLHLTVGGTLSNAGISGQAFKHGPQINNVYQLEVVTGKGEVITCSEEKNADLFYGVLGGLGQFGIITRARIALEPAPKKVKWIRVLYSDFSTFSYDQEHLISSENSFDYIEGFVIINRTGLLNNWRSTFNPKDPLLAKEFSSEGKVLYCLEVAKYFNPEETTKTDQNVDVLLSKLNYIQSTLFQSEVSYVDFLDRVHVSEMKLQEKGLWDIPHPWLNLLIPKSKIHDFAREVFGKILTDTSHGPILIYPVNKSKWRKGTSVVTPEEDVMYLIAFLSSAMPSSTGKDGVEYILNKNKKILNFCRKAHIGMKQYLPHYTTQEDWKGHFGPQWETFKRRKSTYDPLAILAPGQRIFRRASGVQQQ

SEQ ID NO: 59 - DNA, 1632 bp, Artificial Sequence
  Description of Artificial Sequence: Synthetic polynucleotide
atgaaattaccatcccattttttatttaagcaaaatgacttgctcctgaaattgcttatattcatactctgcagttgttcaagcaacaaaaataaactctgctgtaattatcatcagtttgccacccctgcagtttctaccccctcaagtttctcactgaattatttatcattgaaacaattacaacttgaaggttaccttaaatttgacaacttagaacatgcagccaaagactttggtaatagatgccacttccttccattagcagttttgtacccaaaatcagtttctgatatctcttccactataaaacatgtctttgaaataggttccaaaactgatttaactgttgctgctagaggccatggccattctctagaaggtcaagctcaagcttatcaaggagtagtgattagtatggaatcactacaaacaccagcaatgaaattcaagactggagaattgccttatgttgatgtttctgctggagagctttggattaatatcctgaaagaaagtcttaaacttgggcttgcacctaaatcttggactgattatcttcacctcacagttggcggcactttgtctaatgctggaatcagtggacaagctttccgccacggaccgcagatcaataacgtccaacaacttgaagttgtcactggtaaaggagaggtgattacttgttcagaggagcagaatgcagacttgtttcatggtgtactaggaggactggggcaatttggtattattaccagagcaaggattgctcttgaaacagcacctaaacaggtcaagtggattagagtgctgtattcagatttttccatattttccaatgatcaagagcacttgatatcaactcaggatacatttgactatattgaaggttttgtcactatcaaccaaactggattattaaataactggaggtctgctttcaatcctaaagatccagttctagccagcaatttcagttctgagggtagagttttgttctgcttagaaattgccaaatacttcaatccagaagtcacagatagtattgatcagaacattgatgtgatcttatcaaagttgaattatatccgatccacgctgttcctatcagaagtctcctacacagaattcctcgacagggtgcatgtctctgagatgaaactccaagaaaatgtttctcatccatggctaaatcttctaataccaaaaagcaggattcttgaatttgcacaacaagtttttggcaagattcttactgacactagcaatggtcctttactcatctaccctgtcaacaaatcaaagtggagaaaaggaacatccatggttacccctgacgaagatgttttttatctgatcgcgttcctatcttctgctatgtcatcttcaacaggaaacgatggactaagacatattcttgctcagagcaaaaggatactgaacttttgtgaagaaacaaatatcggaatgaaacaatatttaccaaattacaagactaaggaagagtggaaggatcactttggtcatcaatgggaagcatttgctagaaggaaatctacatatgaccctttggcaatacttgctcctggccagagaattttcagaagggcagaagcctgtgaacaacaataa

SEQ ID NO: 60 - protein, 543 aa, Artificial Sequence
  Description of Artificial Sequence: Synthetic polypeptide
MKLPSHFLFKQNDLLLKLLIFILCSCSSNKNKLCCNYHQFATPAVSTPSSFSLNYLSLKQLQLEGYLKFDNLEHAAKDFGNRCHFLPLAVLYPKSVSDISSTIKHVFEIGSKTDLTVAARGHGHSLEGQAQAYQGVVISMESLQTPAMKFKTGELPYVDVSAGELWINILKESLKLGLAPKSWTDYLHLTVGGTLSNAGISGQAFRHGPQINNVQQLEVVTGKGEVITCSEEQNADLFHGVLGGLGQFGIITRARIALETAPKQVKWIRVLYSDFSIFSNDQEHLISTQDTFDYIEGFVTINQTGLLNNWRSAFNPKDPVLASNFSSEGRVLFCLEIAKYFNPEVTDSIDQNIDVILSKLNYIRSTLFLSEVSYTEFLDRVHVSEMKLQENVSHPWLNLLIPKSRILEFAQQVFGKILTDTSNGPLLIYPVNKSKWRKGTSMVTPDEDVFYLIAFLSSAMSSSTGNDGLRHILAQSKRILNFCEETNIGMKQYLPNYKTKEEWKDHFGHQWEAFARRKSTYDPLAILAPGQRIFRRAEACEQQ

SEQ ID NO: 61 - DNA, 960 bp, Artificial Sequence
  Description of Artificial Sequence: Synthetic polynucleotide
atgagaaactcttcactaatgtgcaaacaagtatggccaactttgcgaaatttgcctcaaaaggacaaggttgtgtttgtgatgggagtcaccggcgccggaaaatcaagactgtcaatagacttagccactcaattcagaggagaaatagtgaactccgacaaaatacaagtgtacaaaggtcttgatattgccactaacaaaatcacacaagaagaacgttgtggtgtaccacaccatctcctaggcgtaattgatccttacaaagaattcaccaccaaaaacttctgcaacatggcttcacttgcagttaactctataaccgaccgcggtaaacttccgatcatcgttggaggttccaattcgtttatcgaggcgcttgtccacgacaactctcataattttcgtacgaggtatgattgttgtttcctatgggtcgatgtgtccatgaacgtactaaattcatttttgtacgaacgagtggacaaaatgatggagcaaggtatgactgacgaagtaagaagcatgttcaatccaaaaaacacagattataccaaaggcatacgtaaagcaattggcgtaccagaattcgatagttattttcgagctgaattatcaaattctgttgacgtggagacgcgcgagaggctactaaaagaagctattaatgaagtgaagatcaataactgtatactagcaagtaagcaactagagaaaataaagagactcataaatgttaagggatggaaaattcaaagattagatgcaacagaagtttttaggaggaaacagagaaatgcagaggaagaagccgaggaaatttggaagaatatggtgatgggacagagcataaagattgtgggtaaatttttatgcgaaaataatcggagcaaaatggtttacagaaatgatgtgacagccattaagagagcagcagcgtcggccatagctcaatattag

SEQ ID NO: 62 - protein, 319 aa, Artificial Sequence
  Description of Artificial Sequence: Synthetic polypeptide
MRNSSLMCKQVWPTLRNLPQKDKVVFVMGVTGAGKSRLSIDLATQFRGEIVNSDKIQVYKGLDIATNKITQEERCGVPHHLLGVIDPYKEFTTKNFCNMASLAVNSITDRGKLPIIVGGSNSFIEALVHDNSHNFRTRYDCCFLWVDVSMNVLNSFLYERVDKMMEQGMTDEVRSMFNPKNTDYTKGIRKAIGVPEFDSYFRAELSNSVDVETRERLLKEAINEVKINNCILASKQLEKIKRLINVKGWKIQRLDATEVFRRKQRNAEEEAEEIWKNMVMGQSIKIVGKFLCENNRSKMVYRNDVTAIKRAAASAIAQY

SEQ ID NO: 63 - DNA, 930 bp, Artificial Sequence
  Description of Artificial Sequence: Synthetic polynucleotide
atggaagctgctcaacaacaaaaccagcagcactatcttcaccaacaacatttatcaattggacaggtggcaaacaacattgaagatggtgttggtggtaatagcagcaaaaacaacagcagcagtttcatgtgcaggcaaagtagtacgaggtggacacccacaactgaccagataagaattttgaaggacctttactacaacaatggagttaggtctccaactgctgaacagattcagaggatctctgctaagttaagacagtacggtaagattgaaggcaagaatgtgttttattggtttcagaaccataaagctcgtgaaaggcaaaagaagaggcttattgctgctgctgccactgataacaacaataatatccccatgcaaatgagaggtgtttggagatctgctgatgatcccattcaccacaagtataacaacactacaggtattcactgtccatcagcttcttctcatggtgtactagcagttggacagaatggaaactatggttatggaactgtagctatggagaagagctttagggactgttcaatatcaccaggtggtaactccaacggatcaatgggtcatcaaaacattacatgggttggagttgatccctacacttctcatcaagcatacccttttcttgaaaagactaaacattttgatgaaaccctagacgattatgaggaactgcaacaagaagaagaaaattaccaaagagcctctgctttagaaactctcccactttttcccatgcacgaagagaacatttccagtttctgcaacatcaaacatgaatcttcaggcggattctacacagaatggtatcgttcagatgatcataacttggctgctgcggccagagcttctcttgaactcagtctcaactctttcattggcagatctcctaattccccttaa

SEQ ID NO: 64 - protein, 309 aa, Artificial Sequence
  Description of Artificial Sequence: Synthetic polypeptide
MEAAQQQNQQHYLHQQHLSIGQVANNIEDGVGGNSSKNNSSSFMCRQSSTRWTPTTDQIRILKDLYYNNGVRSPTAEQIQRISAKLRQYGKIEGKNVFYWFQNHKARERQKKRLIAAAATDNNNNIPMQMRGVWRSADDPIHHKYNNTTGIHCPSASSHGVLAVGQNGNYGYGTVAMEKSFRDCSISPGGNSNGSMGHQNITWVGVDPYTSHQAYPFLEKTKHFDETLDDYEELQQEEENYQRASALETLPLFPMHEENISSFCNIKHESSGGFYTEWYRSDDHNLAAAARASLELSLNSFIGRSPNSP

SEQ ID NO: 65 - DNA, 822 bp, Artificial Sequence
  Description of Artificial Sequence: Synthetic polynucleotide
atggaagctgcccaacaacaaaaccagcagcactatcttcaccaacaacatttatcaattggacaggtgacaaacaacattattgaagatggtgttggtggtaatagcagcaaaaacaacagcagcagtttcatgtgcaggcaaagtagtacgaggtggacacccacaactgaccagataagaatcttgaaggatctttactacaacaatggagttaggtctccaactgctgaacagattcagaggatctctgctaagttaagacagtacggtaagattgaaggcaagaatgtgttttattggtttcagaaccataaagctcgtgaaaggcaaaagaagaggcttattgctgctgctgctactgatagcaacaataatattcccatgcacatgagaggtgtttggagatctgctgatgatcctatccaccacaagtataacaacactacaggtattcactgtccatcagcttcttctcatggtgtactggccgttggacagaatggaaactatggttatggaactttagctatggaaaagagctttaggactaaacattttgatgaaaccctagtagacgattatgaggaactgcaacaagaagaagaaaattaccaaagagcctctgctttagaaactctcccactttttcccatgcatgaagagaacatctccagtttctgcaacatcaaacatgaatcttcaggcggattctacacagaatggtaccgttcagatgatcataacttggctgctgcggccagagcttctcttgaacttagtctcaactctttcattggcagatctcctaattccccttaa

SEQ ID NO: 66 - protein, 273 aa, Artificial Sequence
  Description of Artificial Sequence: Synthetic polypeptide
MEAAQQQNQQHYLHQQHLSIGQVTNNIIEDGVGGNSSKNNSSSFMCRQSSTRWTPTTDQIRILKDLYYNNGVRSPTAEQIQRISAKLRQYGKIEGKNVFYWFQNHKARERQKKRLIAAAATDSNNNIPMHMRGVWRSADDPIHHKYNNTTGIHCPSASSHGVLAVGQNGNYGYGTLAMEKSFRTKHFDETLVDDYEELQQEEENYQRASALETLPLFPMHEENISSFCNIKHESSGGFYTEWYRSDDHNLAAAARASLELSLNSFIGRSPNSP

SEQ ID NO: 67 - DNA, 291 bp, Artificial Sequence
  Description of Artificial Sequence: Synthetic polynucleotide
atggattcgaagagttttctgctactactactactcttctgcttcttgttccttcatgatgcttctgatctcactcaagctcatgctcacgttcaaggactttccaaccgcaagatgatgatgatgaaaatggaaagtgaatgggttggagcaaatggagaagcagagaaggcaaagacgaagggtttaggactacatgaagagttaaggactgttccttcgggacctgacccgttgcaccatcatgtgaacccaccaagacagccaagaaacaactttcagctcccttga

SEQ ID NO: 68 - protein, 96 aa, Artificial Sequence
  Description of Artificial Sequence: Synthetic polypeptide
MDSKSFLLLLLLFCFLFLHDASDLTQAHAHVQGLSNRKMMMMKMESEWVGANGEAEKAKTKGLGLHEELRTVPSGPDPLHHHVNPPRQPRNNFQLP

SEQ ID NO: 69 - DNA, 396 bp, Artificial Sequence
  Description of Artificial Sequence: Synthetic polynucleotide
atgtgtattccatatcttgatccgtttgtttcttactcacttatagatcaacaacttgcatctactgcatttctgttcgcttctgaaatgactaatttcactgccaaacgtttcaccctcttcctcttgctgtgtgttttggttgtgcaagaatctcatgggtgcactagtagctcaaaatgcatttcacaaaaggaagttgcttctgtgagaatactaaacagaaaggttttaggaagccagcgggctgcttttggaaagggcttaaatggaaactacaatcattcagggaagattaatgacaagtttgctgattgggagcttaggggaattccagctggtcctgatccattgcaccacaatggtgctaatccgaagaaaccccggactccataa

SEQ ID NO: 70 - protein, 131 aa, Artificial Sequence
  Description of Artificial Sequence: Synthetic polypeptide
MCIPYLDPFVSYSLIDQQLASTAFLFASEMTNFTAKRFTLFLLLCVLVVQESHGCTSSSKCISQKEVASVRILNRKVLGSQRAAFGKGLNGNYNHSGKINDKFADWELRGIPAGPDPLHHNGANPKKPRTP

SEQ ID NO: 71 - DNA, 1158 bp, Artificial Sequence
  Description of Artificial Sequence: Synthetic polynucleotide
atgttaggatcctttggttcatcatctcaatctcatgatgaagaagctgatgatcaacggcggagatgcagttccacttcccctgcaatccaaatccggcaactactcattagctgcgcggagttaatctcacggtccgatttctcggcggcaaacagactcctcaccattttatcaactaactcttccccttttgccactaatttcttgacacctaatgcatcatctaatgttgttgaaagttcaaatgattcagctctacttcagtcatcctatctttccctaaaccaagtgaccccttttattagatttagtcagctaactgctaatcaagcgattttagaagctattaacgataaccaacaagcgatccacatcgttgattttgatattaatcacggtgttcaatggccaccgttaatgcaagcactagctgatcgttaccctcctccaactcttcggattaccggtactggaaatgacctcgatacccttcgtagaaccggagatcgtttagctaaatttgctcactctttaggccttagatttcagtttcaccctcttttgatcaccaataataatgacaatgatcatgacccttcaatcatttcttctattgttcttctccctgatgagacattagcaatcaactgtgtattttatcttcacaggctcttaaaagaccgcgaaatgttaaggatttttttgcataggattaaatccatgaaccctaaagttgtaacactggccgagagagaagcaaatcataatcacccactttttttgcaaagatttgtggaggctttggattattatgcagctgtctttgattcattggaagcaactttgccgccgagcagtagagagaggatgacagtggagcaagtttggttcggaagagaaattatagatatagtagcagcagaaggagataagagaagagaaagacacgagagattcagatcatgggaagtaatgttgaggagctgtggatttagcaatgttgctttaagtccttttgcactttcacaagctaaacttctcttgagacttcattacccttctgaaggataccagcttagtgtttcgagtacgagtaattctttcttcttgggttggcaaaatcaaccccttttttccatatcttcttggcgttaa

SEQ ID NO: 72 - protein, 385 aa, Artificial Sequence
  Description of Artificial Sequence: Synthetic polypeptide
MLGSFGSSSQSHDEEADDQRRRCSSTSPAIQIRQLLISCAELISRSDFSAANRLLTILSTNSSPFATNFLTPNASSNVVESSNDSALLQSSYLSLNQVTPFIRFSQLTANQAILEAINDNQQAIHIVDFDINHGVQWPPLMQALADRYPPPTLRITGTGNDLDTLRRTGDRLAKFAHSLGLRFQFHPLLITNNNDNDHDPSIISSIVLLPDETLAINCVFYLHRLLKDREMLRIFLHRIKSMNPKVVTLAEREANHNHPLFLQRFVEALDYYAAVFDSLEATLPPSSRERMTVEQVWFGREIIDIVAAEGDKRRERHERFRSWEVMLRSCGFSNVALSPFALSQAKLLLRLHYPSEGYQLSVSSTSNSFFLGWQNQPLFSISSWR

SEQ ID NO: 73 - DNA, 1224 bp, Artificial Sequence
  Description of Artificial Sequence: Synthetic polynucleotide
atgttaggatcctttggttcatcatctcaatctcatgatgaagaaactgatgatcaacggcggagattcagttccacttcccctgcaatccaaatccggcaactactcattagctgcgcggagttaatctcgcggtccgatttctcggccgcaaacagactcctcaccattttatcaactaactcttccccttttggtgattcaactgaaagattagtccatcagttcactcgcgcactttctcttcgcctcaaccgttatatctcttcagccactaatttcttgacaccatctaatgttgttgaaagttcaaatgattcagctctacttcagtcatcctatctttccctaaaccaagtgactcctttcattagatttagtcagctaactgctaatcaagcgattttggaagctattaacgataaccaacaagcgatccacatcgttgattttgatattaatcacggtgttcaatggccaccgttaatgcaagcactagctgatcgttaccctcctccaactcttcggattaccggtactggaaatgaccttgatacccttcgtagaaccggagatcgtttagctaaatttgctcactctttaggccttagatttcagtttcaccctcttttgattaccaataataatgacaatgatcatgacccttcaataatttcttctattgttcttctccctgatgagacattagctatcaactgtgtattttatcttcacaggctcttgaaagaccgcgaaaagttaaggatttttttgcataggattaaatccatgaaccctaaagttgtaacgctggccgagagagaagcaaatcataatcacccactttttttgcaaagatttgtggaggctttggattattatgcagctgtgtttgattcattggaagcaactttgccaccgagcagtagagagaggatgacagtggaacaagtttggttcgggagagaaataattgatatagtagcagcagaaggagataagagaagagaaagacacgagagattcagatcatgggaagtaatgttgaggagctgtggatttagcaatgttgctttaagcccttttgcactctcacaagctaaacttctcttgagacttcattacccatctgaaggataccagcttagtgtttcgagtacgagtaattctttcttcttgggttggcaaaatcaaccccttttttccatatcttcttggcgttaa

SEQ ID NO: 74 - protein, 407 aa, Artificial Sequence
  Description of Artificial Sequence: Synthetic polypeptide
MLGSFGSSSQSHDEETDDQRRRFSSTSPAIQIRQLLISCAELISRSDFSAANRLLTILSTNSSPFGDSTERLVHQFTRALSLRLNRYISSATNFLTPSNVVESSNDSALLQSSYLSLNQVTPFIRFSQLTANQAILEAINDNQQAIHIVDFDINHGVQWPPLMQALADRYPPPTLRITGTGNDLDTLRRTGDRLAKFAHSLGLRFQFHPLLITNNNDNDHDPSIISSIVLLPDETLAINCVFYLHRLLKDREKLRIFLHRIKSMNPKVVTLAEREANHNHPLFLQRFVEALDYYAAVFDSLEATLPPSSRERMTVEQVWFGREIIDIVAAEGDKRRERHERFRSWEVMLRSCGFSNVALSPFALSQAKLLLRLHYPSEGYQLSVSSTSNSFFLGWQNQPLFSISSWR

SEQ ID NO: 75 - DNA, 1014 bp, Artificial Sequence
  Description of Artificial Sequence: Synthetic polynucleotide
atggggagagctccatgttgtgataaagcaaatgtgaagagagggccatggtctcctgaagaagatgctaaactcaaagatttcattcacaaatatggaactggtggaaattggattgctcttcctcaaaaagctggtctaaagagatgtgggaagagttgtagattgagatggctaaattatttaaggcctaacattaaacatggtgatttttctgaggaagaagatagagttatttgcaccttgtattccaccattggaagcaggtggtcaataatagcagctcaattaccgggaagaactgacaatgatatcaagaattactggaatactaagctcaagaaaaaacctatgggattaatgcaatcaactaaccaaagaaaatcaccatattttccagctactaattctcttcaaacccaaccccagataaattcaagtctttttagagacttatattacaccccaaataataggcctaatattacaggcctaaatcatcagtccatttcttctgcccaccagacaaattttctctacactaataataacatgaactttcctaatttgggtgctacaaataatcaatatccttataatatccaaagtcataatttacttatgtttggagaagcaagttgttcttcatcagatggaagttgcagccaaatgagttttggtaaagaaatcaagagagaagaaattatgagtaatagtttacaacaaggtcaaatttcaagtgttaatgcttttgaagaaaaccaccagaattttactcttgattatggcaatagtagtagtaattgggtggatcaaaaaccaaatgtgtattttggtactactactactcaagtacttcagtatgataatgttgaagaagttaagcagcagctaacaagttgtaccaatggcaacaatggtagtactattggatgtaacaacaacaacagtatgttcgtgttcaatgatgagaattataacaagtcaaatgagatagagatgttctattactga

SEQ ID NO: 76 - protein, 337 aa, Artificial Sequence
  Description of Artificial Sequence: Synthetic polypeptide
MGRAPCCDKANVKRGPWSPEEDAKLKDFIHKYGTGGNWIALPQKAGLKRCGKSCRLRWLNYLRPNIKHGDFSEEEDRVICTLYSTIGSRWSIIAAQLPGRTDNDIKNYWNTKLKKKPMGLMQSTNQRKSPYFPATNSLQTQPQINSSLFRDLYYTPNNRPNITGLNHQSISSAHQTNFLYTNNNMNFPNLGATNNQYPYNIQSHNLLMFGEASCSSSDGSCSQMSFGKEIKREEIMSNSLQQGQISSVNAFEENHQNFTLDYGNSSSNWVDQKPNVYFGTTTTQVLQYDNVEEVKQQLTSCTNGNNGSTIGCNNNNSMFVFNDENYNKSNEIEMFYY

SEQ ID NO: 77 - DNA, 1011 bp, Artificial Sequence
  Description of Artificial Sequence: Synthetic polynucleotide
atggggagagctccatgttgtgataaagcaaatgtgaagagagggccatggtctcctgaagaagatgctaaactcaaagatttcattcacaaatatggaactggtggaaattggattgctcttccccaaaaagcaggtctaaagagatgtgggaagagttgtagattgagatggctaaattatctaaggcctaatatcaaacatggtgatttttcggaggaagaagatagagttatttgcagcttgtattccaccattggaagcaggtggtcaataatagcagctcaattaccaggaaggactgacaatgatatcaagaattactggaatactaaactcaagaaaaagcttatgggattaatgcaatcaacaaaccaaagaaaatcaccatattttccagctactaattctcttcaaacccaaccccagataaattcaagtctttttagagacttatattacaacccaaataataggcctattattacaggcctaaatcagtccatttcttctgcccaccagccaaattttctctacactaatagtaacatgaattttcctaatttgggtgctacaaatagtcaatatccttataatattcaaagtcataatttacttatgtttggagaagcaagttgttcttcatcagatggaagttgtagccaaatgagttttggcaaagaaatcaagagagaggaaattatgagtaattgtttacaacaaggtcaaatttcaagtgttaatgcttttgaagaaaatcagaatttcactcttgattatggtaacagtagtagtaattgggtggatcaaaaaccaaatgtgtattttggaaatactactactactactcaagtacttcagtatgatgttgaagaagttaagcagcagctaacaagttgtaccaatggcaacaatggcagtactattggatgtaacaacaacaacagtatgttcgtgttcaatgatgagaattataacaagtcaaatgagatagggatgttctattactga

SEQ ID NO: 78 - protein, 336 aa, Artificial Sequence
  Description of Artificial Sequence: Synthetic polypeptide
MGRAPCCDKANVKRGPWSPEEDAKLKDFIHKYGTGGNWIALPQKAGLKRCGKSCRLRWLNYLRPNIKHGDFSEEEDRVICSLYSTIGSRWSIIAAQLPGRTDNDIKNYWNTKLKKKLMGLMQSTNQRKSPYFPATNSLQTQPQINSSLFRDLYYNPNNRPIITGLNQSISSAHQPNFLYTNSNMNFPNLGATNSQYPYNIQSHNLLMFGEASCSSSDGSCSQMSFGKEIKREEIMSNCLQQGQISSVNAFEENQNFTLDYGNSSSNWVDQKPNVYFGNTTTTTQVLQYDVEEVKQQLTSCTNGNNGSTIGCNNNNSMFVFNDENYNKSNEIGMFYY

SEQ ID NO: 79 - DNA, 495 bp, Bacillus amyloliquefaciens
atgaaaaggaatcagcttcacatgatgaaaatgggaggtattgctttgaaaaaacgattatcgtggatttccgtttgtttactggtgcttgtctccgcggcggggatgctgttttcaacagctgccaaaacggaaacatcttctcacaaggcacacacagaagcacaggttatcaacacgtttgacggggttgcggattatcttcagacatatcataagctacctgataattacattacaaaatcagaagcacaagccctcggctgggtggcatcaaaagggaaccttgcagacgtcgctccggggaaaagcatcggcggagacatcttctcaaacagggaaggcaaactcccgggcaaaagcggacgaacatggcgtgaagcggatattaactatacatcaggcttcagaaattcagaccggattctttactcaagcgactggctgatttacaaaacaacggaccattatcagacctttacaaaaatcagataa

SEQ ID NO: 80 - protein, 164 aa, Bacillus amyloliquefaciens
MKRNQLHMMKMGGIALKKRLSWISVCLLVLVSAAGMLFSTAAKTETSSHKAHTEAQVINTFDGVADYLQTYHKLPDNYITKSEAQALGWVASKGNLADVAPGKSIGGDIFSNREGKLPGKSGRTWREADINYTSGFRNSDRILYSSDWLIYKTTDHYQTFTKIR

SEQ ID NO: 81 - DNA, 1290 bp, Arabidopsis thaliana
atgaacaacaacattttcagtactactaccaccatcaatgacgactacatgttattcccttataatgaccattattcctcacaaccattgctcccttttagcccttcttcttccattaacgacatcttgattcactccacctctaacacatcaaacaatcatcttgaccatcatcatcaattccaacaaccttctcctttttctcacttcgaatttgccccggactgcgccctcctcacctctttccacccagaaaacaatggccatgatgataaccaaaccatcccaaacgacaatcatcatccatcacttcactttcccttgaacaacaccattgtagaacaacccactgagccctcggaaactataaaccttatagaagattcccagagaatctcaacttctcaagacccaaaaatgaaaaaagccaagaaacccagcagaacggacaggcacagcaagatcaaaacggccaaagggacacgagatcgtaggatgagactctcgctagatgtcgccaaagagttgtttggcttacaagacatgcttggatttgacaaagccagcaaaaccgttgaatggttgcttacacaagcaaaacctgagatcataaagatcgcgacaaccctttctcaccatggctgcttcagcagcggcgatgagtctcatatccgatccatggacacatcttctgatctatgtgaacttgcatccatgtggacggtcgacgatagaggcagcaatactaacacgaccgaaacaagaggaaacaaggtcgatgggagatcgatgagagggaagagaaagaggccagaaccgcgaacgcccattttaaagaagttgtccaaggaggagagagcgaaagctagagaaagagcaaagggtagaacaatggagaaaatgatgatgaagatgaaaggaagatcacaattagtgaaagttgtggaagaagacgctcatgatcatggtgagataataaagaataataatagaagccaagtgaatcggagttcttttgagatgacacactgcgaagacaagatcgaagaactttgcaagaacgatcgttttgcagtttgcaacgaatttatcatgaataagaaagatcacatttcaaatgaatcttatgacttagtcaactacaaaccgaactcatcattcccagtgattaaccaccatcgcagccaaggagcagctaattccattgagcagcatcagtttacggatcttcattactccttcggcgcgaaaccaagagacctcatgcacaactatcaaaacatgtattga

SEQ ID NO: 82 - protein, 429 aa, Arabidopsis thaliana
MNNNIFSTTTTINDDYMLFPYNDHYSSQPLLPFSPSSSINDILIHSTSNTSNNHLDHHHQFQQPSPFSHFEFAPDCALLTSFHPENNGHDDNQTIPNDNHHPSLHFPLNNTIVEQPTEPSETINLIEDSQRISTSQDPKMKKAKKPSRTDRHSKIKTAKGTRDRRMRLSLDVAKELFGLQDMLGFDKASKTVEWLLTQAKPEIIKIATTLSHHGCFSSGDESHIRSMDTSSDLCELASMWTVDDRGSNTNTTETRGNKVDGRSMRGKRKRPEPRTPILKKLSKEERAKARERAKGRTMEKMMMKMKGRSQLVKVVEEDAHDHGEIIKNNNRSQVNRSSFEMTHCEDKIEELCKNDRFAVCNEFIMNKKDHISNESYDLVNYKPNSSFPVINHHRSQGAANSIEQHQFTDLHYSFGAKPRDLMHNYQNMY

SEQ ID NO: 83 - DNA, 299 bp, Artificial Sequence
  Description of Artificial Sequence: Synthetic polynucleotide
atgtatccgccaagcaacagctgcaactacagccccattttcaacatcccttctccttgtatgcaatatggagacgaactattcttccaatattatcctgaccatttccttcaacagcaacaagtgcctttgatagaagatcagagtgttgacatcttagctgattgcactgagaatgttactaacgaagaaactgtcatcaatactgatactgtaaaagttctttatgacacaggagctgttacaaacagtcagtgttggggaggaaatgaagaagtagaagaaggccgcgaaaacaa

SEQ ID NO: 84 - DNA, 318 bp, Artificial Sequence
  Description of Artificial Sequence: Synthetic polynucleotide
atggctcgctccttgtgtttcatggcatttgcagtcttggcaatgatgctctttgttgcctatgaggtgcaagctagagaatgcaaaacagaaagcaatacattccctggattatgcattaccaaaccaccatgcagaaaagcttgtatcagtgagggatttactgatggtcattgtagcaaaatcctcagaaggtgcctatgcactaagccatgtgtgtttgatgagaagatgatcaaaacaggagctgaaacttttgctgaggaagcaaaaactttggctgcagctttgcttgaagaagagataatggataactaa

SEQ ID NO: 85 - DNA, 300 bp, Artificial Sequence
  Description of Artificial Sequence: Synthetic polynucleotide
atggcagggaaggttgagaaagtgcttgcagtagtgatgcttgcaatgcttctgttttcggagcatttaatggctgctaatcatgaaattaaaacaactgaagataactctactattagccctttctgcttagtaaaatgtttatttggatgtagggggttgccacctgtacaagcatccatttgtgctgctcaatgttatttaaagtgccgtgaccaagatgcggccaatattgctgaaactaagggcataattggtgagactgcatacaaccagtatgatgttggatgtgcccttggc

SEQ ID NO: 86 - DNA, 300 bp, Artificial Sequence
  Description of Artificial Sequence: Synthetic polynucleotide
atgtatccgtcaagcaacagctgtaattacagcctcaatatttcctcctcaaataacttatttcacattccatctccgaattctatgcaatatgaacacgaacttttccaatattttcatgaccatcatctccttcaaccccaacaacaacaacaacaacaacaactcttgactacacctgatcattatatggcagcagattccaacaaagacaccgtaatcagtagtactaatcaagatcctgaagaagttgaattacaaggccgctgcaagaacaaaaaaggtgacaataagagacgt

SEQ ID NO: 87 - DNA, 362 bp, Artificial Sequence
  Description of Artificial Sequence: Synthetic polynucleotide
atggaaaaggttcatgagaaaccgctatctctttataatggatcattatctgtttttagattaggagatttggctgtgaaaataacaaaggtgaaaaagggatcattaaataatgataatctttcacccccaacttcattgttagttgtttcaccaatcataccaggaacttatccagttttactcttttttcatggcttcgttctcaagcctatatggtacaagtctctccttcaacatatttcttcccacggctatatagttgttgctccacaggtttctcaaagcgaagaagtgaaaaaagcagccaaagttacagaatggttaagtaaagccctcgaatccgtactgccggagaaagt

SEQ ID NO: 88 - DNA, 300 bp, Artificial Sequence
  Description of Artificial Sequence: Synthetic polynucleotide
atgtgtttgttaataaaggtggcgaatccaggagaatccggcgagcatgacagaattccatcaacgggaggtgattcagaaagtacaactactaccacagaaggaggaattccgcagctatatgaacaattacaatcacaatcacaatcatttgaagaaatgttgcggcaacaaatacaacaagaaacagagtatttgatgtcttcatctgcaactcctatgttttcacggtatagtcagacaagggagatgtcggcaatggtaacggcgttaacgcatgtggtatcaggacggagagag

SEQ ID NO: 89 - DNA, 300 bp, Artificial Sequence
  Description of Artificial Sequence: Synthetic polynucleotide
atggcacatttcttctctataaattcaacgttagcaggaacgaataaagcatccaaaacaaatttcacatattcaactcaagaaacagaaaaaccaaaaataaagatcatcttactcttgttttctcttgcattagttcccttgtcagcgatggcaacttgcaccactgatactccaaaccaagcactattgagggatgtacacgatatagatggtaacccccttcaagtaaaagccaggtacttcatatttccagttattggcggtggtggtgtacggcttgctaatcttggagatcaa

SEQ ID NO: 90 - DNA, 348 bp, Artificial Sequence
  Description of Artificial Sequence: Synthetic polynucleotide
atggctgagcaacaccagcgccaccagcaacagcagcagcagcagcagatgcaagtgggccacccgacggaggcaatcaagagccttcttcctcaaaggggtccctctaaatcccaagtccttgctgtcgtcactctcttccctgttggtggggccctcctctgccttgctggactgacgctcgccggaactctgatcgggcttgcagtcgctacgccggttttcttactgttcagcccggttttggtccccgctgccctgacaatcgcgttggccgtcactggattcttgacttccggcgcctttggaataacggcgctgtcgtcgctctcgtggatcattaactat

SEQ ID NO: 91 - DNA, 300 bp, Artificial Sequence
  Description of Artificial Sequence: Synthetic polynucleotide
atgaacggtggttcatgtggtggtgctgatcgtgagtataataacaataacaacaataatgttgtaggtggaggaggtggcgggccttgtggtgcatgcaagtttcttagaagaaaatgtgtgaggggatgcatatttgcaccttattttgattctgatcaaggcactgctcatttcgctgctgtacataaggtgtttggtgctagcaatgcctctaaattgctgctcagaattccagcgcataaacgtctggatgctgtcgttacactttgctatgaggctcttgctagagttagagac

SEQ ID NO: 92 - DNA, 300 bp, Artificial Sequence
  Description of Artificial Sequence: Synthetic polynucleotide
atgtcggataaaaaatctgtctcgacgccatttgaatgttgcagaatcttgtttaagtttctgctgtttatggttattatcagtaatgtggcgatccatgtaacagctttgagtgggcgagaaggaataaccccaagtacggaatggggtttggggcctctggtgaagagaggagaaagaaaactagtagtttcaactgaaaatggggaggtctcttcagtcagagtagctgatggaatcaccggttcctatcatcttcagttcatcacattggagcccaattccctcttccttcctgtt

SEQ ID NO: 93 - DNA, 293 bp, Artificial Sequence
  Description of Artificial Sequence: Synthetic polynucleotide
atgggcgtaccagaatcggaggtggtgtcacaaggtgaggttgaatcaccattgcaaccagatcaaaaccagcacaagaaccatcagttcccgtccctcggtagacaagcatcgatctactccctcactctcgacgaattccaacacaccctatgtgaaagtggcaagaatttcgggtcgatgaatatggatgaattcctaacagcatttggactgctgaagaaaaccaagcccacgcacacgcccatgcccatgccgcgcacgggcatgcgcacgcgcattctcatgctcat

SEQ ID NO: 94 - DNA, 300 bp, Artificial Sequence
  Description of Artificial Sequence: Synthetic polynucleotide
atggaggaaaaagatgaacttgaggaagaagaagaatatgttgatgatgaaatcaagaacaatttaccagtccaaaactcatcttcaataagttggttcacaaaaatgatatctttacaagtagagatcttcaccactatcttagtttcccccattttctatatcctctcttttgtatctgacttcaacttcctccgccctgaagaaaccgaaaagaacgtagctgtagctgtaaatgctgctgctacagtaccttcaaaagtagtacatggaagtactttactgctcaagaaatttggt

SEQ ID NO: 95 - DNA, 300 bp, Artificial Sequence
  Description of Artificial Sequence: Synthetic polynucleotide
atgtataactcaagcaactacagctgtaattacaaccccattttctcatctaatttattcaacatcccttctccttgtatgcaatatgaacacgaacttttcttccaatattaccatgatcaacttcaacagaatcttgacgataccttagctgagatcagtactgagactgccattattaacacggcagattccagcaaagacgaggctataatcagtagaaatgaacttgaacaagatcaggaagcgcgtaagaataaaaagggtaaagtaagcagcaacaagagagtgtctaagaaa

SEQ ID NO: 96 - DNA, 300 bp, Artificial Sequence
  Description of Artificial Sequence: Synthetic polynucleotide
atgggaactggtacttatggagaagtgggacgtacaatacatcaaagatcaggaacacatatacctcaaattctcgatccgcctttgctaggggatagtgattgcaagcgagaaggcaaacatgtagaatttatgcctccaatcatgggtgaaaacttaaaagcagctaatcaatttgaactgatggccccgtcaattgcattcaaatcatatccctattcggaggtaccacaatattctggtggcaatgtggctgctgcatgtggtgaatctttggtacatcaaaatatagaaagatca

SEQ ID NO: 97 - DNA, 320 bp, Artificial Sequence
  Description of Artificial Sequence: Synthetic polynucleotide
aggacaaggttgtgtttgtgatgggagtcaccggcgccggaaaatcaagactgtcaatagacttagccactcaattcagaggagaaatagtgaactccgacaaaatacaagtgtacaaaggtcttgatattgccactaacaaaatcacacaagaagaacgttgtggtgtaccacaccatctcctaggcgtaattgatccttacaaagaattcaccaccaaaaacttctgcaacatggcttcacttgcagttaactctataaccgaccgcggtaaacttccgatcatcgttggaggttccaattcgtttatcgaggcgctt

SEQ ID NO: 98 - DNA, 297 bp, Artificial Sequence
  Description of Artificial Sequence: Synthetic polynucleotide
gaagatggtgttggtggtaatagcagcaaaaacaacagcagcagtttcatgtgcaggcaaagtagtacgaggtggacacccacaactgaccagataagaatcttgaaggatctttactacaacaatggagttaggtctccaactgctgaacagattcagaggatctctgctaagttaagacagtacggtaagattgaaggcaagaatgtgttttattggtttcagaaccataaagctcgtgaaaggcaaaagaagaggcttattgctgctgctgctactgatagcaacaataatatt

SEQ ID NO: 99 - DNA, 339 bp, Artificial Sequence
  Description of Artificial Sequence: Synthetic polynucleotide
tctaatgttgttgaaagttcaaatgattcagctctacttcagtcatcctatctttccctaaaccaagtgactcctttcattagatttagtcagctaactgctaatcaagcgattttggaagctattaacgataaccaacaagcgatccacatcgttgattttgatattaatcacggtgttcaatggccaccgttaatgcaagcactagctgatcgttaccctcctccaactcttcggattaccggtactggaaatgaccttgatacccttcgtagaaccggagatcgtttagctaaatttgctcactctttaggccttagatttcagtttcaccctctt

SEQ ID NO: 100 - DNA, 480 bp, Artificial Sequence
  Description of Artificial Sequence: Synthetic polynucleotide
actgacaatgatatcaagaattactggaatactaagctcaagaaaaaacctatgggattaatgcaatcaactaaccaaagaaaatcaccatattttccagctactaattctcttcaaacccaaccccagataaattcaagtctttttagagacttatattacaccccaaataataggcctaatattacaggcctaaatcatcagtccatttcttctgcccaccagacaaattttctctacactaatagtaacatgaattttcctaatttgggtgctacaaatagtcaatatccttataatattcaaagtcataatttacttatgtttggagaagcaagttgttcttcatcagatggaagttgtagccaaatgagttttggcaaagaaatcaagagagaggaaattatgagtaattgtttacaacaaggtcaaatttcaagtgttaatgcttttgaagaaaatcagaatttcactcttgat

SEQ ID NO: 101 - DNA, 900 bp, Artificial Sequence
  Description of Artificial Sequence: Synthetic polynucleotide
atgaattcaaagaaaaacaactcaccaagaaaaaggttgagaaaatatcatacaagaaaagctcctattattagctcttatatggacatggctgaagctagaagagaaattgttcatgctttacaacttcatcgatcttcatcttcatctccaactccgtctattaatagcccaaagaagtacacattattgggtcaaggagttgtaagctctcaacaatattactattactcaatagtggaatctatgcctattcctgaaccaacatggtctacaacggctccggcaatacttaatgcaatgggaactggtacttatggagaagtgggacgtacaatacatcaaagatcaggaacacatatacctcaaattctcgatccgcctttgctaggggatagtgattgcaagcgagaaggcaaacatgtagaatttatgcctccaatcatgggtgaaaacttaaaagcagctaatcaatttgaactgatggccccgtcaattgcattcaaatcatatccctattcggaggtaccacaatattctggtggcaatgtggctgctgcatgtggtgaatctttggtacatcaaaatatagaaagatcaatgtctgatccccttgtgattggtagagtgattggggaagttgttgattatttcactccaagtgttaagatgtctgttacttataacagcagcaagcatgtttataatgggcatgaactctttccttcctcagtcacctctaaacctagggttgaagttcatggaggtgatttgagatctttctttacaatgatcatgatagacccagatgttcctggtcctagtgatccatatctcagggaacacctacactggattgtcacagacattccaggcactacagattgctcgtttgggaaa

SEQ ID NO: 102 - DNA, 150 bp, Artificial Sequence
  Description of Artificial Sequence: Synthetic polynucleotide
caccacatagattgaacggagggaataatagtgtagccccattgggaaacaccatatttatataggtagaagaaatactccagatttaactagaatttctactgacaaaagatcttttacactatcaatcacttaaaagataactacagg

SEQ ID NO: 103 - DNA, 141 bp, Artificial Sequence
  Description of Artificial Sequence: Synthetic polynucleotide
cactaagctttcttttcctcataacctcacttgcttctcctttgttcttctttcgtctcctcctttgtttcgcctccccttgttctggtaactcttgagtgtagataccaggatagtactgagaaatgagtatcatttgat

SEQ ID NO: 104 - DNA, 150 bp, Artificial Sequence
  Description of Artificial Sequence: Synthetic polynucleotide
catgaaccaacacaataggaggcaaatcagtgttagtcttttttgaatcatctgttttaaggctagtttccaaatttggcttgaaaagccaatcgctcagagtctgggaaacatcaccggccactgaaacagctctgtcaattggaatgt

SEQ ID NO: 105 - DNA, 165 bp, Artificial Sequence
  Description of Artificial Sequence: Synthetic polynucleotide
gttatcacaattcacaagggaaagttcataacatgaccactgtcgaatcaaaaagggaaagttcatatataatacgcttaggctttgggtttttcaaatgaagggtagagttcttcataaacgaaattccacattgttacttcatatttcacatattcccgaata

SEQ ID NO: 106 - DNA, 153 bp, Artificial Sequence
  Description of Artificial Sequence: Synthetic polynucleotide
ttctccttatacctcctgagtaccataatttacactcatctatgtccaatgccttacatcccacccatctaatttcctgaacacaagctacactaatcttctaatgagcgcaaaatacaacacaaaattattgctcgctagtcaaagataata

SEQ ID NO: 107 - DNA, 180 bp, Artificial Sequence
  Description of Artificial Sequence: Synthetic polynucleotide
tgggacatttgatagttagacgttgtaactttaggttgaaatctgcagtcgagttcattgttctctttataataatcacttgaaactggttgctggctacacgctgctgttgcttcaacatgcagatatggcgctaccggccgtagtgcagatgtgggagtttccatttcaggcttggca

SEQ ID NO: 108 - DNA, 560 bp, Artificial Sequence
  Description of Artificial Sequence: Synthetic polynucleotide
attactcttaactttaaatagatttcttatatatgggttcaaaaatgtctgatccccttgtgattggtagagtgattggggaagttgttgattatttcactccaagtgttaagatgtctgttacttataacagcagcaagcatgtttataatgggcatgaactctttccttcctcagtcacctctaaacctagggttgaagttcatggaggtgatttgagatctttctttacaatgatcatgatagacccagatgttcctggtcctagtgatccatatctcagggaacacctacactggattgtcacagacattccaggcactacagattgctcgtttgggaaagaaatagttggctatgaaatgccaaggccaaatattggaattcacaggtttgtatttctgctgttcaagcagaagaagaggcaaacagtattgactgcacctctctccagggatcgatttaatacgcgtaaattcgcagaagaaaatgagcttgggtctcctgttgcagcagttttcttcaattgccagagggaaactgctgccagaaggcgttga

SEQ ID NO: 109 - DNA, 522 bp, Artificial Sequence
  Description of Artificial Sequence: Synthetic polynucleotide
atggctcaaatgacagatccccttgtgattagtagggtggttggagatgttgttgattatttctctccaagtgttaagatgtgtgttatttataaccccagtaagcatgtctataatgggcatgaactctttccatcccttgttacctctaaacctaaggttgaagttcatggaggtgacatgagatccttctttacactgatcatgactgaccctgatgttcctggtcctagcgatccatatcttagggagcacttacattgggtaattacagacattccaggcactacagattcctcgtttggaaaagaagtggtgggctatgaaatgccaatgcctaacattggaatccataggtttgtgtttctgctcttcaagcagaagaagaggcaaacagtgagcgcaccattatccagggaccgattcaatacgcggaaatacgcagaagaaaatgagcttggctctccagttgctgctgttttcttcaactgccaaagggaaaccgcggccagaaagcgttga

SEQ ID NO: 110 - DNA, 453 bp, Artificial Sequence
  Description of Artificial Sequence: Synthetic polynucleotide
atggctcaaatgagtacagatccccttgtgattggcagggtggttggagatgttgttgattatttctccccaagtgttaaaatgtctgttatttgtaaccccagcaaacatgtctataatgggcatgaactctttccatcctctgttacctctaaacctaaggttgaagttaacggaggtgacatgacatccttctttacattgatcatgactgaccctgatgttcctggtcctagtgatccatatattagggagcacttgcactggaaaagaattaagtggtgggctatgaaatgccaatgccaaataaaggaatccataggtttgtgtttgtgctgttcaagcagaagaaaaggcaaacagtatgcattatccagggaccgattcaataccaatacagctgctgctgttttcttcaattgccaaagggaaaccgcggccagaaggcgttga

SEQ ID NO: 111 - DNA, 3155 bp, Artificial Sequence
  Description of Artificial Sequence: Synthetic polynucleotide
aagcttccagaaggtaattatccaagatgtagcatcaagaatccaatgtttacgggaaaaactatggaagtattatgtgagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtggatcctgcaggctagcgtgcactctagactcgacgaactgacgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactatgataaattatcgcgcgcggtgtcatctatgttactagatcgggaattcctcgagcaactatttttatgtatgcaagagtcagcatatgtataattgattcagaatcgttttgacgagttcggatgtagtagtagccattatttaatgtacatactaatcgtgaatagtgaatatgatgaaacattgtatcttattgtataaatatccataaacacatcatgaaagacactttctttcacggtctgaattaattatgatacaattctaatagaaaacgaattaaattacgttgaattgtatgaaatctaattgaacaagccaaccacgacgacgactaacgttgcctggattgactcggtttaagttaaccactaaaaaaacggagctgtcatgtaacacgcggatcgagcaggtcacagtcatgaagccatcaaagcaaaagaactaatccaagggctgagatgattaattagtttaaaaattagttaacacgagggaaaaggctgtctgacagccaggtcacgttatctttacctgtggtcgaaatgattcgtgtctgtcgattttaattatttttttgaaaggccgaaaataaagttgtaagagataaacccgcctatataaattcatatattttcctctccgctttgaattgtctcgttgtcctcctcactttcatcagccgttttgaatctccggcgacttgacagagaagaacaaggaagaagactaagagagaaagtaagagataatccaggagattcattctccgttttgaatcttcctcaatctcatcttcttccgctctttctttccaaggtaataggaactttctggatctactttatttgctggatctcgatcttgttttctcaatttccttgagatctggaattcgtttaatttggatctgtgaacctccactaaatcttttggttttactagaatcgatctaagttgaccgatcagttagctcgattatagctaccagaatttggcttgaccttgatggagagatccatgttcatgttacctgggaaatgatttgtatatgtgaattgaaatctgaactgttgaagttagattgaatctgaacactgtcaatgttagattgaatctgaacactgtttaaggttagatgaagtttgtgtatagattcttcgaaactttaggatttgtagtgtcgtacgttgaacagaaagctatttctgattcaatcagggtttatttgactgtattgaactctttttgtgtgtttgcagctcataaaaggtaccaaacaatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttttgagcgggactctggcgatcgccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggactagt

SEQ ID NO: 112 - DNA, 11801 bp, Artificial Sequence
  Description of Artificial Sequence: Synthetic polynucleotide
tgagcgtcgcaaaggcgctcggtcttgccttgctcgtcggtgatgtacttcaccagctccgcgaagtcgctcttcttgatggagcgcatggggacgtgcttggcaatcacgcgcaccccccggccgttttagcggctaaaaaagtcatggctctgccctcgggcggaccacgcccatcatgaccttgccaagctcgtcctgcttctcttcgatcttcgccagcagggcgaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgccagaaggccgccagagaggccgagcgcggccgtgaggcttggacgctagggcagggcatgaaaaagcccgtagcgggctgctacgggcgtctgacgcggtggaaagggggaggggatgttgtctacatggctctgctgtagtgagtgggttgcgctccggcagcggtcctgatcaatcgtcaccctttctcggtccttcaacgttcctgacaacgagcctccttttcgccaatccatcgacaatcaccgcgagtccctgctcgaacgctgcgtccggaccggcttcgtcgaaggcgtctatcgcggcccgcaacagcggcgagagcggagcctgttcaacggtgccgccgcgctcgccggcatcgctgtcgccggcctgctcctcaagcacggccccaacagtgaagtagctgattgtcatcagcgcattgacggcgtccccggccgaaaaacccgcctcgcagaggaagcgaagctgcgcgtcggccgtttccatctgcggtgcgcccggtcgcgtgccggcatggatgcgcgcgccatcgcggtaggcgagcagcgcctgcctgaagctgcgggcattcccgatcagaaatgagcgccagtcgtcgtcggctctcggcaccgaatgcgtatgattctccgccagcatggcttcggccagtgcgtcgagcagcgcccgcttgttcctgaagtgccagtaaagcgccggctgctgaacccccaaccgttccgccagtttgcgtgtcgtcagaccgtctacgccgacctcgttcaacaggtccagggcggcacggatcactgtattcggctgcaactttgtcatgcttgacactttatcactgataaacataatatgtccaccaacttatcagtgataaagaatccgcgcgttcaatcggaccagcggaggctggtccggaggccagacgtgaaacccaacatacccctgatcgtaattctgagcactgtcgcgctcgacgctgtcggcatcggcctgattatgccggtgctgccgggcctcctgcgcgatctggttcactcgaacgacgtcaccgcccactatggcattctgctggcgctgtatgcgttggtgcaatttgcctgcgcacctgtgctgggcgcgctgtcggatcgtttcgggcggcggccaatcttgctcgtctcgctggccggcgccagatctggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgaagcttccagaaggtaattatccaagatgtagcatcaagaatccaatgtttacgggaaaaactatggaagtattatgtgagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtggatcctgcaggctagcgtgcactctagactcgacgaactgacgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactatgataaattatcgcgcgcggtgtcatctatgttactagatcgggaattcctcgagcaactatttttatgtatgcaagagtcagcatatgtataattgattcagaatcgttttgacgagttcggatgtagtagtagccattatttaatgtacatactaatcgtgaatagtgaatatgatgaaacattgtatcttattgtataaatatccataaacacatcatgaaagacactttctttcacggtctgaattaattatgatacaattctaatagaaaacgaattaaattacgttgaattgtatgaaatctaattgaacaagccaaccacgacgacgactaacgttgcctggattgactcggtttaagttaaccactaaaaaaacggagctgtcatgtaacacgcggatcgagcaggtcacagtcatgaagccatcaaagcaaaagaactaatccaagggctgagatgattaattagtttaaaaattagttaacacgagggaaaaggctgtctgacagccaggtcacgttatctttacctgtggtcgaaatgattcgtgtctgtcgattttaattatttttttgaaaggccgaaaataaagttgtaagagataaacccgcctatataaattcatatattttcctctccgctttgaattgtctcgttgtcctcctcactttcatcagccgttttgaatctccggcgacttgacagagaagaacaaggaagaagactaagagagaaagtaagagataatccaggagattcattctccgttttgaatcttcctcaatctcatcttcttccgctctttctttccaaggtaataggaactttctggatctactttatttgctggatctcgatcttgttttctcaatttccttgagatctggaattcgtttaatttggatctgtgaacctccactaaatcttttggttttactagaatcgatctaagttgaccgatcagttagctcgattatagctaccagaatttggcttgaccttgatggagagatccatgttcatgttacctgggaaatgatttgtatatgtgaattgaaatctgaactgttgaagttagattgaatctgaacactgtcaatgttagattgaatctgaacactgtttaaggttagatgaagtttgtgtatagattcttcgaaactttaggatttgtagtgtcgtacgttgaacagaaagctatttctgattcaatcagggtttatttgactgtattgaactctttttgtgtgtttgcagctcataaaaggtaccaaacaatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttttgagcgggactctggcgatcgccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggactagtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatatcaactcccctatccattgctcaccgaatggtacaggtcggggacccgaagttccgactgtcggcctgatgcatccccggctgatcgaccccagatctggggctgagaaagcccagtaaggaaacaactgtaggttcgagtcgcgagatcccccggaaccaaaggaagtaggttaaacccgctccgatcaggccgagccacgccaggccgagaacattggttcctgtaggcatcgggattggcggatcaaacactaaagctactggaacgagcagaagtcctccggccgccagttgccaggcggtaaaggtgagcagaggcacgggaggttgccacttgcgggtcagcacggttccgaacgccatggaaaccgcccccgccaggcccgctgcgacgccgacaggatctagcgctgcgtttggtgtcaacaccaacagcgccacgcccgcagttccgcaaatagcccccaggaccgccatcaatcgtatcgggctacctagcagagcggcagagatgaacacgaccatcagcggctgcacagcgcctaccgtcgccgcgaccccgcccggcaggcggtagaccgaaataaacaacaagctccagaatagcgaaatattaagtgcgccgaggatgaagatgcgcatccaccagattcccgttggaatctgtcggacgatcatcacgagcaataaacccgccggcaacgcccgcagcagcataccggcgacccctcggcctcgctgttcgggctccacgaaaacgccggacagatgcgccttgtgagcgtccttggggccgtcctcctgtttgaagaccgacagcccaatgatctcgccgtcgatgtaggcgccgaatgccacggcatctcgcaaccgttcagcgaacgcctccatgggctttttctcctcgtgctcgtaaacggacccgaacatctctggagctttcttcagggccgacaatcggatctcgcggaaatcctgcacgtcggccgctccaagccgtcgaatctgagccttaatcacaattgtcaattttaatcctctgtttatcggcagttcgtagagcgcgccgtgcgtcccgagcgatactgagcgaagcaagtgcgtcgagcagtgcccgcttgttcctgaaatgccagtaaagcgctggctgctgaacccccagccggaactgaccccacaaggccctagcgtttgcaatgcaccaggtcatcattgacccaggcgtgttccaccaggccgctgcctcgcaactcttcgcaggcttcgccgacctgctcgcgccacttcttcacgcgggtggaatccgatccgcacatgaggcggaaggtttccagcttgagcgggtacggctcccggtgcgagctgaaatagtcgaacatccgtcgggccgtcggcgacagcttgcggtacttctcccatatgaatttcgtgtagtggtcgccagcaaacagcacgacgatttcctcgtcgatcaggacctggcaacgggacgttttcttgccacggtccaggacgcggaagcggtgcagcagcgacaccgattccaggtgcccaacgcggtcggacgtgaagcccatcgccgtcgcctgtaggcgcgacaggcattcctcggccttcgtgtaataccggccattgatcgaccagcccaggtcctggcaaagctcgtagaacgtgaaggtgatcggctcgccgataggggtgcgcttcgcgtactccaacacctgctgccacaccagttcgtcatcgtcggcccgcagctcgacgccggtgtaggtgatcttcacgtccttgttgacgtggaaaatgaccttgttttgcagcgcctcgcgcgggattttcttgttgcgcgtggtgaacagggcagagcgggccgtgtcgtttggcatcgctcgcatcgtgtccggccacggcgcaatatcgaacaaggaaagctgcatttccttgatctgctgcttcgtgtgtttcagcaacgcggcctgcttggcctcgctgacctgttttgccaggtcctcgccggcggtttttcgcttcttggtcgtcatagttcctcgcgtgtcgatggtcatcgacttcgccaaacctgccgcctcctgttcgagacgacgcgaacgctccacggcggccgatggcgcgggcagggcagggggagccagttgcacgctgtcgcgctcgatcttggccgtagcttgctggaccatcgagccgacggactggaaggtttcgcggggcgcacgcatgacggtgcggcttgcgatggtttcggcatcctcggcggaaaaccccgcgtcgatcagttcttgcctgtatgccttccggtcaaacgtccgattcattcaccctccttgcgggattgccccgactcacgccggggcaatgtgcccttattcctgatttgacccgcctggtgccttggtgtccagataatccaccttatcggcaatgaagtcggtcccgtagaccgtctggccgtccttctcgtacttggtattccgaatcttgccctgcacgaataccagcgaccccttgcccaaatacttgccgtgggcctcggcctgagagccaaaacacttgatgcggaagaagtcggtgcgctcctgcttgtcgccggcatcgttgcgccacatctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccacaattatgggtgatgctgccaacttactgatttagtgtatgatggtgtttttgaggtgctccagtggcttctgtgtctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcaacagcccgcattatgggcgttggcctcaacacgattttacgtcacttaaaaaactcaggccgcagtcggtaacctcgcgcatacagccgggcagtgacgtcatcgtctgcgcggaaatggacgaacagtggggctatgtcggggctaaatcgcgccagcgctggctgttttacgcgtatgacagtctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagttggagtcattacccaattatgatagaatttacaagctataaggttattgtcctgggtttcaagcattagtccatgcaagtttttatgctttgcccattctatagatatattgataagcgcgctgcctatgccttgccccctgaaatccttacatacggcgatatcttctatataaaagatatattatcttatcagtattgtcaatatattcaaggcaatctgcctcctcatcctcttcatcctcttcgtcttggtagctttttaaatatggcgcttcatagagtaattctgtaaaggtccaattctcgttttcatacctcggtataatcttacctatcacctcaaatggttcgctgggtttatcgcacccccgaacacgagcacggcacccgcgaccactatgccaagaatgcccaaggtaaaaattgccggccccgccatgaagtccgtgaatgccccgacggccgaagtgaagggcaggccgccacccaggccgccgccctcactgcccggcacctggtcgctgaatgtcgatgccagcacctgcggcacgtcaatgcttccgggcgtcgcgctcgggctgatcgcccatcccgttactgccccgatcccggcaatggcaaggactgccagcgctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccgg

SEQ ID NO: 113 - DNA, 2499 bp, Artificial Sequence
  Description of Artificial Sequence: Synthetic polynucleotide
tctaggagcaaaaaaaaaaaaaaaaaaaaaaacaagtagtagtagtagtagtaaatggaaaaatagagaggcaattttttttagtatcttactttatccattagcacttaaaaaacataggtttacatgctctcattgtcacgccaggccgctaattaaatggtacatttcatcatccccattttttggcctcatagttaattatcacaatttctgaaagcaacatcagaacaaccccacatttcttgtggtcctataattactgctagatagtccaaacccatctgcctatttagggcttgtgaatgaggattgaaaatggtagagaatatttgcaaaggcatcatgcatatatggaaaagactaaagagagagttagtgccttgcaaagcggattctcacagttgtagaaaaggactcaccattttcaagaatactcccggcatgaagatggacaatttaatataaaaaacaaagaaaatagtaattaagtgcgttgagatgaatgaaatttatccgctcttaattgaatatggggaattgaaagaaatttctgataataaattaatgagtcttacatgacgtggatccgacttaatctagtctatttaaactaagaatagataagaatagagaatatagacaaaagagaggctcattggctagggtttcaagggagttccttgaacataagtggcaagtacaagcacaaagccaatttccatggactaaagatgaataagatgtgtcgtgtggtatggtgggaaggtgaggaggtatggggtaattggagatgctaaacctctctaaaagctcttttgctccaaatatctaaatccatctctatcacttttggcgactgccccaaaatttgcaacttatgaattaaagttttaatatttttaagttaataaattctgaattaataatttaacatattcaataaactttttaaaacaaattacgtatataccatcaaactggctgcaccatgatcactttctaaactcacaatgacatatggatttaatcaggcacaaagtcatgttgatagaaagagatagtacggagaatgaagaaaaaaggtaggggagagagatggggtgagtggggaaaagatagggttctctttttagtgaaagcgacagggtctgagaaccctaggtcaaaagttgcataaacctctatacaggcttcttcactcccttactactaatatactctcattaaggcttgaggtttaattcattaaaattgtggtttaattattgtatcccctcaaacgaaataattgtccttgtcgaggttagacaatgttgcgtactattttcaaacgcagtcagccattattctcctatcctttacagtcgagattcaaagacagaaagtagcatgcaagctgttattaatttactttgattaggactttgccaagaaaatgaagaaccttttcttttttcttttaatttagttatcttacaacatgtaatttttcctagcaagcaaatacggtaacttttttttttattctcatttaatttgttggagctattgctactttgatgacttcaaccaaatcctggttggtaggcggagggtgctgacgatggaaactacccctcttgtccaaatacgataacctaaaaaatagaataatagcttattgtactgtgctgcaaaaattgcattgtcagtatacataattaaaatctattttgaatgtgtggagggcaaagaggggtgactggtctagggttgtagaaatcaggtgggagagagaatggtatttgtctctgtgtcagctgatatcacgtgaagaggcacaataagaagtccttcgtatccattcacttcccaaaaataccggcattactacaaatatagtactagcacttgctttctctatccccatctttgctatttcctttccctttccaactttttggctttagaattgcaaagatggagggaattgtggttctttgtatctgtaaaatttttcctccaagctccagttgtagctagcttaatgcgtggacgcgcgcgcacacactagaaatctgcaatctatatatatattcacaaggcactcacatatcaaaaaccacatagacattgtatagagagagctgtcgttctcaagcagaaaaaatgatatgatttcatcagcatgtggtcaaccaaatagttcaattctagtctttgcttcctctttctaattactgtataaatagagccacaaggacatagaattgagaaaataaaagacaataaaaacaaatctagctacttaagcgaatgatgatgactctctctcagtagtcttaactcttaatacccttgttttccttcttgtgctgcagtttgattggttaattaacctaatcaaaagatgttttaactgtgttttatccgtctttctcaagatctatcttagtcccaccacatagctccctcaagctacagctgcaaaatatatactatatatatatataacaa

SEQ ID NO: 114 - DNA, 2500 bp, Artificial Sequence
  Description of Artificial Sequence: Synthetic polynucleotide
tgacattgctttggtggtttaagttctcagccagtatatgcattgtcctaataggtctcacatggaagcagcactgagagttgtaagatacataaaagaagctcctggcttaggtctcttcttgcctgtaaaatcttcagatcaactaagtgctttttgtgactcagattggggagcatgtatacaaattagaaggttagttacagggtacttggtaaagtttgaaagtgctcttatatcctggaagtctaagaagcagagtactgtgtctaggagctctaatgaagctgagtttataagtatggcttcatgtgcagcagaagttacctggccggtaggactgttcagtgaacttggtgtcaaggttaaacttcctataaacttggtatgtgatagtaaagctgcaatccaaattgcagcaaatccaatcttccatgaaagaacaaaacatattgatatagactgtcactttgtaaaggaaaagctaagtctaaggatgctaaaaactgagtatgtcaacatgaggatcaactggcagatatacttacaaaaggattgtgaagagctcaacatgtacatttgctgaacaagctagggttgaagaatctgtatcaaccatcagcttgagagggagtgttaatcaacatggttaccactagtttatttataaagtgtaaatgctaaaccatagctagtgagttagttaatagttagttgagtttgttataaatattagtcagctgtacagtttaacatagcttctctttcagaaatgaaaattgctcttctctcatttcctctcttctagattcttcttctccctccttctcttagctcagatctctcttatgacagctaacaataaatacgaatatttcttgtaacggttgctcattgaatgttgtctttctcaaccgatatctttctttcaagttttccccccgattcgagtatttttgaaactcactcagcaccggtcacatattcgtaatcggtgccagctatttgcttactcatatcttatttgacttcattgtcacgtgtcagacagaagtatgtgcgcatataccatcaagtctcaatttgaaataaaatcaacttaagcagttaaaagtcaaatctcttttagttcggtctttaaaataataatttaaataatgaacctataaaacacgcaactcacactgaatataggggcagacataaaagccgaaagactgaattccgaaccggaccgaattatttcggtatttcgatatcggtttattcagtatttcggtactatttcggtataggatttttagttattcggtatttcggtacgatcctcggtattgaaatttcgatatttcggtataccgaaataccgaataatttaagtacaccttccttcactgcccagcccgttatcaattttcagcccaagtttctaacttgttatttctttcccttagccagtagcctactaagattaagcccaacgccccaacctaacattagaaattattataattagaaaagtataaagaaagtactcacattctactgctatgctcatgtagtgatttctattagaaattattagaagtgaaggtactgcccacattttcttgttgctatactcattatcacgcaattagaaattttctaatgaattagaattcagtagttcagcacagaggcggatgtagcgtattacctacgggttcaactgaacctataactttcgacacagagtaaaaatttatatgtaaaaattctttaaaattgtaaaaatcgtagatatgaacccataactttaaaaatataatgggtaacattaaaattgaacccatagaatttaaatcctggattcgcctctggttcagcattgtttagttcacaaaaatatggtacgatgccgaaccgtatcgaaaccataccgaaccaaacaagaagatatcgaacaataccgaactactttggtacagtatttggtatgcacacttgatatatcgaataccgaaataccgaaccgtaattttcgaataccgtaccgaaataccgaacactcacccataactaaacattaaaaagctagaactcaggtgtttaatgactaaacggaagtaagatctagataatccgtcactctgttgatttgtaaggctatcgacatgcaaaagtggaagcaaaatggagccgaaattttaacaaaaatgctgaaccaataccatgaaattgatgaatggtgggaccctatttcactcttttagaatttgcgtaagaccagaaaataacttcaatcgaaatcaaaataaataccaacccttttaggccccaaatcactacgtgtgatttgcaaacgtcattagccttatgtaaacagtgacctcatgccaacatattatcgcagcctataaatcttagtttacatttcattttctttcaaacacacacacctcacaatagaactaagttgtaagagtttcattttctttgttctttctcacaaaccaaa

SEQ ID NO: 115 - DNA, 2500 bp, Artificial Sequence
  Description of Artificial Sequence: Synthetic polynucleotide
tgccagacagtctaaaattcaaaaataggacagcccacatcccctccaccccactagatctcactacttcttaattaggacttgtgggggggagtagagggatttgcaaaggcggccgcggcatgcatatacggaaaagagaagttagtggtttgcaaagatgattgtggaaaagggcttacctaacaatgaagaagaggaagagggtagatggataataataactcaaaaatagaaagaagagggacaagtgggggctcaatggctaaggttttaagggaggtcttggaaacatcattagcaagtacatgcagtattaccaccctacatcagactgtggggtctgatggaatattcttctactatactcttttaaatagagggaattaatgagcctttataatgttgaaatttataagaaaatagtataactttttaaatctcttaattatgtatcaaatcaaatctcatatttaccctttagtggatctattcactgaagtctgaataaatcgtaccagtaattcataccgaatgtgtaaataatttgaaagaaagatagacaaggcctcaatgkctagggatttgttagcatcaatagcaagtataagcagaaatatataccaccaaggagtgaggtggaagaattaagatttactctaatgaaatatatatatcaagattgagtcatgtgaatgaagaatttcttagtaccttaaattaagcgaatatcacataacagaggtgtaaaaaaacgaaagatggacaagctaagtggctctcaatggctggggttttaagggatcggaggtcttgttaacatcagacggaagtacaattagagtatatatgctactctaataatacttggctacaaacataaaaaaatatctctatcactatctctcaactcgccatatagacttaattggcacaaagtcatgctgatggaaagagatataaggagaatgggaagacaaaaaaaaaagtggggatagaaagagtgtccaagtagctagaagggggtgggggtggggggtgggggagttgttgttttagttgtggaagagataggtttctctttttagtgaaagtgacatatatagctagactgagaaccctggtcaaaagttgctttgccttaacgtttctaaatgcctgacctctgagaggctatcttctcctctcattctctcgacccttactgttcatatacccccaaatttgaggtctaatttatccacactatggtttcttactgttgtcttcttctctgaaacaatattgcttgtcgatcttggacttggccacgtcaacgtgtaacttcagcaactagggtgactccaagtcatagacagatctaggtcgacttctgtgaatttaactaaacaaattatttaatttcgactcaaaatagatatgtactatatatatatatagtaaacttattgtgaacttactaacttaaaattttcaagtttgcagtattttttggaataagaaaggggaaaaagaggcagaaaaccccatatttcttcctctttggagttgacgctaaagggataaagctaacatgcaagctcttaacaaataacatactcagtataatctcacaaatggggtatagagaggataaaacgtacacaaatcttaacaatatacacagtgtaattccataagtgagttctgtggacggtagtagcttaccccttgcctttaacatgcaagctcttaagctttgtatttttattttgttctttctttttggagaggaagaagtggtggttgaagactagagataaggaagaaaagagaaggatttttgtcagttgctatcacgtgaactgaaggggcacaattagagagaagtctatatgcttcacttcccataaaatcagttgtaactacaacaagtactaagagtgtcccctccattttctttctttccctcaattccctttcatacttttaaagcttaattccacagctagaaaaagaagcctttctttttctctagaggtatttagcaaagatggaaggacaatattacagctctctttgtctctacaggtaacaaaccattgcctgtctttctcaatctccagtatttccagctatcttataatgctttgagtactcccacaaaacacatgcattatagccactagctacatatatatatatatttgtaaaaccacacattaatttagctgtcattctcaaccaaaaagctatgttatcatcaacatattgacaaattacctataattccttcccctctagctatatgatctatctcactttattatgcacttaaaaagttatgttgtccctctcaaaagtcttaattaattaaccttgttttgcatcttgctgcagctagctagcttattaaattgacaaactcagaagatgttgtggttctttcaacttcaataaaaagctaagagtagtacttgtgcttgtatatccgtccttctcaagctcaagtcccacttca

SEQ ID NO: 116 - DNA, 3433 bp, Artificial Sequence
  Description of Artificial Sequence: Synthetic polynucleotide
  modified_base (3171)..(3178): a, c, t, g, unknown or other
gttggagctaaaaataagagaaatggacaagtgtcaaattctagcgtccatggtagcgcgacgcactattgtggcgctagaaatagaagaccaaaatttccaatgttggcgtcgaccttgcgttgcggtattttttctatttcgctagggacaagattatttcaacaaaaggggttctaaacctaatttggaggatatctaacatactttgaaggcgaattcacgtaagggaatacaaaccacgcttggaaggggctttcaactagtttttcttctcttcttttctcttcctttcatctcattatgtattagttctagggttgttggtacttacattaacgttatagtttgaagcttggattatcttattattttatcatattggtttatttattcaatcttgcgcttgataatttaattttaattgattgatcaccaattaaatactatctacgaatttaggattgaaatcgggagagaaaattttagattgcatataggattgagtagagtaagatcttgaacctgaattacgagggaacgaatttgcgattaggatataaggatatacctaatcgtcttgcttggttactatacgggaattattaatacgttcttattaatcctaatccactggaatataggcgttgagttagcttgaacaggcgagtagtacttcgggagaatactacgagtaatattaaattgtcaatcaataaactagataaatttataagatagtttaagtaaaaaactcaatgagattgttagttgacccataactctgaaatattttctcccattagattgtctttaagcttgccggcatagtttttctagttttctagtttacaactctagattagttatagttaacaatcacactttagaaaatcgcttgagtagattaattgttaatttagttgatagttaatcataagtcatcgagggaacgatactctacttatcactttattacttatcgaccacgtatacttgagtgcgtttgggagcaacaaatttttgacgccgttgccgggacgttagttgatgttttcaactagtgaacaaaatgcaaatatgttatgcaattcggtgccatttacacgtctatgaggagttatattaaagaactttatgtaggatgttggttggatcctacaagctaaaattatggctaagaaaattgtgaattactaataaacttgtaataagataaaaaataatttcctagaacgtaatagaattgaagtgagattagaccgacacctcttcgtcggaaaactatgttatatatgtaggttattttatatatatatatatatatatatataattttcttggcgtttaattttttatattttgattcttcctactaataattctaactctatcactgaattaaacgtacaggattcatttcttatacaaaagaggttgatcattattaggtctgggcactgtcagaggctgaccgatatgagtagttcttcacatgcttggcagcaatttgaactgtgattgcttgaggggcgaaaaagagagtagaatctaagttcggtaatttttatctgaattctgtatttgtcttaaaaatttattgagtatgcataaaattattattttaaactcagtaatttaaaaaatttagaattcgaactcataaatttcaaattgggactccacctctgattgtttgtaagtggagtttaggggcagaactagctcaaaaagttcgggttcgattgaactcagtaaatttgattcaaagtctatatatttattgaaaaatcaactaaatatgtatatatacaataaatttcaaattcataaaaatttaaatcctgaattaacctaatagtaaaaccgcagactctaactagtggtctagtttagagagtcaaattatggtttttaacaaccttaaacaagcacaaatacttttccactattggttcaattttggttgttaacaaccttgattggtaattacgtacttgcatgggcatttgaaaattaagttacgtacgtgtaaaacgttttagagtagtccgtactaattaagaacacaaacactgcttgagattttgtggcggaagtttgttttgacttagcatgggtaggcccacgaattccccattttgaataaaagacaacctgtgctagtcgattagctattatttaattactagaatattacttactccctcctttttaatttagacgatttagtttgacttggcacaaagtttaaagaaaaaaaaaagacttttgaaatatgtggtgttaaaatcttaatgggcaaaagctaagtggagtcatgatatttgtgtgactataaaaacttctcattaagaataaagtgagtaaaataaaaaattaaagtcaaattatttctaaatatagaaatatatcattcttttttgaacggactaatacggaaagtgtgtcatttaaattaaaataaataaagtaatatttatcatatgattttaacatgtaaatatcatacaagtaatctaatcgtcaagcgcggatctaataaataagggacgggtattttgtttaggctgtgtatatataattttttaaaatctactaaaaaagaacaaataatagatttgtaaattagagggatatggtagaatctaactataaacccttaaagttcaaatcttgtatctgcttgtggtaatagtgtatatatattttttacacgtttttgttgtatagaactcaaactaaaaagggcattccagtgcacaaagcatctcctattcacacacaattcggtgaagggccgcactgtatgcaaggggtgtgatatcggcagtctatcctgatgcaagcatcaatggttgattccacggctcgaatccgttacctataggtcatacggagataactttaccgttactccaagtcccccttctacataaaacttgcatcaatagctgatttcacgactcgaacccataacctagttgatacgaagataactttaccgttgcttcaaggtccgtctacacaaaactgatcaaattattttcataaataaagaagctatcatttctctataaatagaactagagtccttgcatattccaacataagtatcagttccaggaaaatcaagacataatctgttagcttttctctttgccattctcnnnnnnnnatggattccttaccagtctcctccattgaatctctagtcattgagatcaagaaagagatgttctcaaaccaagaatttaacacttttgtcaccccaatatctgcctatgacactgcttggttggccatgatttcttataataatcaagaagaagccattaatggtcattctttttctggccctatgtttaagagttgtttaaattggattctcaacaaccaaaatgagcaaggattttggggagaatccaatggt

SEQ ID NO: 117 - DNA, 2512 bp, Artificial Sequence
  Description of Artificial Sequence: Synthetic polynucleotide
aagctggtacccttatgtttagtccaagaaaaataaccatacccaaatataagggtttgttgaagacggaaatatataaacaaataaacaaatatcatcatatctccgatagtttaaaattttagattggatatttcacacaatttatcaaaattttcaaaaaaaaattctactttttcttgcttggaacttggaaggggaaggggtggtggtggagatagggcggggcatcttctatctagtctatgtgattaatataacaaaacaaaaagggcgaggcaaaaacatggatgaatggtggtccttttctatatttatatggattgttacgatacgtcgatttcactttgcaaaataccaattagattcatttagttatctttttgatcactctgcttttactatcatatatatataggagtccttccacgtttcgcatgtgtcattgtttatattttccatggtcttccttccaaatggctaaaaaaatttgacacagtggtcccaaaagtttatagaaatagaattcaacagtgaggcatatacctatgaattctattttacatcttcatcgtataaaatagaatgtgttataaactttacctcgtgatgcttacaaggggtgaaaatataaaagcactttatagatttacaagagtcacaccttgatttatcctaagattttatttttttacatgccaaacaatgaagtatgggagatccaattggaataacatcaaatttaataaaattcgaaatagtcagagagctgtctactgaggtatattgaaacttatttttttttaatagaaaatatcaaatacttagcaatatattaaaatgtttcataaattacattgtttaaaccaagcgttgaaacatatgctgatacgaggtaggcttattgatgaatttataagggcctcattggaaaagacgatccaaagcaatgggctaaaaaattggcccattttctgccacccagtgtatggttattactagtttcacccacacagatttgcacttcattagaggacaatgttgctgaatttgaaacataagtccatttatctccactgtacagtccttcctggagtccaatcctgaccatatcttcatgattttatgtaatgtggtgaataagcaaagtttcatgttatgctttgtctcattttatagcaaattcatttcctcataaaatttacttcaaaaaagtttcgtttgattttcagaaatcaaaatatgcttttcggtaaccaaatggttttcaattttgtttacgaagaacttaaaactttccaacaccctacatctatgattgcaagttaaaattgcagaaatatgacactttttggagtggtctttatcgtttaacttcacttgcactttaagggcaaaagttaaaagtgtttccatgaagcaagcgagggataacacttattaaacttgaaattctactcatagaccaaaacaaggacaaaaattcaagactatctatgtgggtaaacgtacgaaaattgggcttctccagattagagccggaccttgtggaaagacagagaaattcgaggcccacttccagtttctaaggagattaagcctatcaaacgatggtccagaacgaaatatgtctttctttattctctactatatagctgactcagaatcgttagaatttgcaatttcctcataataaaatgtgaggcagtatagattcgaaaacctttgttgaagattattgactcagctacgcgaaacaaactgtagtatccaatgtaccgattaacaagcgactggttaactatgaatttgttagctcgacaaaatcaccggttaataatgagtttgtgagttcgataaaatctaattttctgatagaaattttatatattatgcagaaatttaataaaagtagacttaacttatatattttagcattgactcttttgaagtaaaatccattccatctaaattatgacttccctacatcgagtaagtaagttgcgtctgtatcctcattttacccacttttcgctatgcaattattcaaggatctttacacaaatagcaagccaatattaattatttattttttttagtcatatatataaattatacatatattatatacccattaattatttttaatttaagtgatagattggacgactatttggattaattcttcgttattcaagataatagatgtcgtctctaatacatgagctagaagataataaggattactaggccgaaaggctgatggaaatgaacaagaagataagctcctaaatggaaacagtacggaaaaagtcaaagagcagtgcatgggaggaatcatcagtcagaaaaggaagccacgtgtcaagtagaaacaagcacgtgtccatgcaaaagccacgtaactcccttccatcacatcttccttcttcaaaacctcgtgttttactctctcttttctcactgccagtgatcgtcaggactgtgcatgtttgtttaaaaactaaaggca

SEQ ID NO: 118 - DNA, 941 bp, Artificial Sequence
  Description of Artificial Sequence: Synthetic polynucleotide
tttaaaacgccaaaaaataagggacggccatggcgtagcaatgactattgttccgtaggtcatttgtgaaggaccgacaaaattttaggcgatccgggtccgatttttcggttctgctcaagaaaactcgatctgcacgaatagcttataatcaaacccttttttttttttcaagaatgtctaattgatcctaaaaagacaaccttatatgttccaccatggcaggatcggccttattactaagggtttgccaatagacacgtttttaacattcaagtaaaaaaaacatttattcttaataacccacctactatagtacgttatttggcagtagactacgttgtacatttgggaccatttggaacactcgtctttcacgagtcactaatttttgtgttgaatgcataaaatttgtttttttctttttcgaaattgaacaattttatcttcgatcacacctatagtatattattaccttattgttagaaaatattttattttattattgactcctaataaaaagtggggtaaatttgggtcttttttttaaagaatgtgaactactcatttcactttggttagaacaaatatgagaagatttgctaatgacagcaaaatgaatagaccaaaagcgtaacgaatattaaaaataaacaattccgaataactggttactgaaaattgtggaactctacatagccgttgtgagtatggtattgtttgttcttgtgggcagaataactagttacggaaaatttatgaatttgcttcacattatttttttcattttcttttttgcttcaaaagataagtacaagtttttatactcttatttcattgcctataaatacctctattgagttactgctcattcacaactctaaatagcaatctttcttattattaaaattcctatccttttttactcattcagagaaacg

SEQ ID NO: 119 - DNA, 3013 bp, Artificial Sequence
  Description of Artificial Sequence: Synthetic polynucleotide
tttaaaacgccaaaaaataagggacggccatggcgtagcaatgactattgttccgtaggtcatttgtgaaggaccgacaaaattttaggcgatccgggtccgatttttcggttctgctcaagaaaactcgatctgcacgaatagcttataatcaaacccttttttttttttcaagaatgtctaattgatcctaaaaagacaaccttatatgttccaccatggcaggatcggccttattactaagggtttgccaatagacacgtttttaacattcaagtaaaaaaaacatttattcttaataacccacctactatagtacgttatttggcagtagactacgttgtacatttgggaccatttggaacactcgtctttcacgagtcactaatttttgtgttgaatgcataaaatttgtttttttctttttcgaaattgaacaattttatcttcgatcacacctatagtatattattaccttattgttagaaaatattttattttattattgactcctaataaaaagtggggtaaatttgggtcttttttttaaagaatgtgaactactcatttcactttggttagaacaaatatgagaagatttgctaatgacagcaaaatgaatagaccaaaagcgtaacgaatattaaaaataaacaattccgaataactggttactgaaaattgtggaactctacatagccgttgtgagtatggtattgtttgttcttgtgggcagaataactagttacggaaaatttatgaatttgcttcacattatttttttcattttcttttttgcttcaaaagataagtacaagtttttatactcttatttcattgcctataaatacctctattgagttactgctcattcacaactctaaatagcaatctttcttattattaaaattcctatcctaatttactcaaacagagaaacgatgtatccgccaagcaacagctgcaactacagccccattttcaacatcccttctccttgtatgcaatatggagacgaactattcttccaatattatcctgaccatttccttcaacagcaacaagtgcctttgatagaagatcagagtgttgacatcttagctgattgcactgagaatgttactaacgaagaaactgtcatcaatactgatactgtaaaagttctttatgacacaggagctgttacaaacagtcagtgttggggaggaaatgaagaagtagaagaaggccgcgaaaacaaaagaaatgacatgagaagcaccattagtattattcatgtacggaaaaacaagaaatgttccaataaagatcgacatagcaagattaacactgctcgtggcctcagagaccgaaggatgagactttcccttgatgcagctcgcaagtttttcagtttacaagacatgttggggttcgataaggcaagtaaaactgtagaatggttgcttatcaaatcggagtctgaaatcgaagagctagccaaaggcaataaaggaggaggcattcctaaacaaagctgcagtactactaatggaattggtgcaattagtactgcaatatcctctatttctgagtgtgaggttatatcaggaactgatgaatctttctctattacttataaaaagaagctgaaaactgctaaaggagcctcgaaaaagacggctaaaactgctcgtagagctgcatttgatcgtcttattacaagggaaacgaggaatcaagcaagggctagggctagagagagaacaaaaataaagaaaagcctcggtaaatccaaagagaacagtgctgattactgtaatttggtggataattatggagattggagtcaatttagtatcttcaactatcagaaaaatgcagttggaatttcccatgatcaggtgggttcaataattaaacaacatgattttttaggatttcaataggctcgctccttgtgtaacatggcataagcagtcttggcaatgatgctctttgttgcctatggtttgtctccatttattcctctaataccccataaaaataataaaatataaattacatctacatgactggttttgaattatgataatgaacatgaagttacacttcttatgattttttcaagtacattgtgttttgattaccgcataaatatttaagcatggtcatcttttttttgattcatttgttgttagagtgactaattaatctgtagtatatgtctggaggcttgaggaatctgaaaaaatgtgcgtgtttgcatagttctttcaaaatagtataggacaatatattcttttaaaaaaaggagtccggtgcacaaagcatgtcgcattgttccgagtaaaagctgcacccaaagagtgtgatgcagacaacctactctaatacaagcattaatgaacgcgttgctccaaggctccggccccttcaatatatttctttatgaaccgtgaatttattcatgtttaaaagctttctttcaattccatcttttcttttgttctaacatttgttagtaaacgtgaatgaatgtagaggttcaagctagagaatgcaaaacagaaagcaatacattccctggattatgcattaccaaaccaccatgcagaaaagcttgtatcagtgagggatttactgatggtcattgtagcaaaatcctcagaaggtgcctatgcactaagccatgtgtgtttgatgagaagatgatcaaaacaggagctgaaacttttgctgaggaagcaaaaactttggctgcagctttgcttgaagaagagataatggataactaattagagattagaggaaaggattaattcagtgtcacacataataaagttgctgcctttcttaaaaggatagctaatgtattggcttttagtagcctttgttaccctaaaataagtgtgacatgtcaatccttttgatctagtaccaagtttatgtatgttttaatgaaaaatgatcttctatggtcattgcaatcccattatattccaagaacaaaacttcattattttcttggtcc

SEQ ID NO: 120 - DNA, 120 bp, Artificial Sequence
  Description of Artificial Sequence: Synthetic polynucleotide
tagcaatctttcttattattaaaattcctatccttttttactcattcagagaaacgatggctcgctccttgtgtttcatggcatttgcagtcttggcaatgatgctctttgttgcctatg

SEQ ID NO: 121 - DNA, 5668 bp, Artificial Sequence
  Description of Artificial Sequence: Synthetic polynucleotide
tttaaaacgccaaaaaataagggacggccatggcgtagcaatgactattgttccgtaggtcatttgtgaaggaccgacaaaattttaggcgatccgggtccgatttttcggttctgctcaagaaaactcgatctgcacgaatagcttataatcaaacccttttttttttttcaagaatgtctaattgatcctaaaaagacaaccttatatgttccaccatggcaggatcggccttattactaagggtttgccaatagacacgtttttaacattcaagtaaaaaaaacatttattcttaataacccacctactatagtacgttatttggcagtagactacgttgtacatttgggaccatttggaacactcgtctttcacgagtcactaatttttgtgttgaatgcataaaatttgtttttttctttttcgaaattgaacaattttatcttcgatcacacctatagtatattattaccttattgttagaaaatattttattttattattgactcctaataaaaagtggggtaaatttgggtcttttttttaaagaatgtgaactactcatttcactttggttagaacaaatatgagaagatttgctaatgacagcaaaatgaatagaccaaaagcgtaacgaatattaaaaataaacaattccgaataactggttactgaaaattgtggaactctacatagccgttgtgagtatggtattgtttgttcttgtgggcagaataactagttacggaaaatttatgaatttgcttcacattatttttttcattttcttttttgcttcaaaagataagtacaagtttttatactcttatttcattgcctataaatacctctattgagttactgctcattcacaactctaaatagcaatctttcttattattaaaattcctatcctaatttactcaaacagagaaacgtctaggagcaaaaaaaaaaaaaaaaaaaaaaacaagtagtagtagtagtagtaaatggaaaaatagagaggcaattttttttagtatcttactttatccattagcacttaaaaaacataggtttacatgctctcattgtcacgccaggccgctaattaaatggtacatttcatcatccccattttttggcctcatagttaattatcacaatttctgaaagcaacatcagaacaaccccacatttcttgtggtcctataattactgctagatagtccaaacccatctgcctatttagggcttgtgaatgaggattgaaaatggtagagaatatttgcaaaggcatcatgcatatatggaaaagactaaagagagagttagtgccttgcaaagcggattctcacagttgtagaaaaggactcaccattttcaagaatactcccggcatgaagatggacaatttaatataaaaaacaaagaaaatagtaattaagtgcgttgagatgaatgaaatttatccgctcttaattgaatatggggaattgaaagaaatttctgataataaattaatgagtcttacatgacgtggatccgacttaatctagtctatttaaactaagaatagataagaatagagaatatagacaaaagagaggctcattggctagggtttcaagggagttccttgaacataagtggcaagtacaagcacaaagccaatttccatggactaaagatgaataagatgtgtcgtgtggtatggtgggaaggtgaggaggtatggggtaattggagatgctaaacctctctaaaagctcttttgctccaaatatctaaatccatctctatcacttttggcgactgccccaaaatttgcaacttatgaattaaagttttaatatttttaagttaataaattctgaattaataatttaacatattcaataaactttttaaaacaaattacgtatataccatcaaactggctgcaccatgatcactttctaaactcacaatgacatatggatttaatcaggcacaaagtcatgttgatagaaagagatagtacggagaatgaagaaaaaaggtaggggagagagatggggtgagtggggaaaagatagggttctctttttagtgaaagcgacagggtctgagaaccctaggtcaaaagttgcataaacctctatacaggcttcttcactcccttactactaatatactctcattaaggcttgaggtttaattcattaaaattgtggtttaattattgtatcccctcaaacgaaataattgtccttgtcgaggttagacaatgttgcgtactattttcaaacgcagtcagccattattctcctatcctttacagtcgagattcaaagacagaaagtagcatgcaagctgttattaatttactttgattaggactttgccaagaaaatgaagaaccttttcttttttcttttaatttagttatcttacaacatgtaatttttcctagcaagcaaatacggtaacttttttttttattctcatttaatttgttggagctattgctactttgatgacttcaaccaaatcctggttggtaggcggagggtgctgacgatggaaactacccctcttgtccaaatacgataacctaaaaaatagaataatagcttattgtactgtgctgcaaaaattgcattgtcagtatacataattaaaatctattttgaatgtgtggagggcaaagaggggtgactggtctagggttgtagaaatcaggtgggagagagaatggtatttgtctctgtgtcagctgatatcacgtgaagaggcacaataagaagtccttcgtatccattcacttcccaaaaataccggcattactacaaatatagtactagcacttgctttctctatccccatctttgctatttcctttccctttccaactttttggctttagaattgcaaagatggagggaattgtggttctttgtatctgtaaaatttttcctccaagctccagttgtagctagcttaatgcgtggacgcgcgcgcacacactagaaatctgcaatctatatatatattcacaaggcactcacatatcaaaaaccacatagacattgtatagagagagctgtcgttctcaagcagaaaaaatgatatgatttcatcagcatgtggtcaaccaaatagttcaattctagtctttgcttcctctttctaattactgtataaatagagccacaaggacatagaattgagaaaataaaagacaataaaaacaaatctagctacttaagcgaatgatgatgactctctctcagtagtcttaactcttaatacccttgttttccttcttgtgctgcagtttgattggttaattaacctaatcaaaagatgttttaactgtgttttatccgtctttctcaagatctatcttagtcccaccacatagctccctcaagctacagctgcaaaatatatactatatatatatataacaaatgtatccgtcaagcaacagctgtaattacagcctcaatatttcctcctcaaataacttatttcacattccatctccgaattctatgcaatatgaacacgaacttttccaatattttcatgaccatcatctccttcaaccccaacaacaacaacaacaacaacaactcttgactacacctgatcattatatggcagcagattccaacaaagacaccgtaatcagtagtactaatcaagatcctgaagaagttgaattacaaggccgctgcaagaacaaaaaaggtgacaataagagacgtgttgcttacaagaaagatagacacagcaagattaacactgctcacggccctagagaccgaagaatgagactttctctcgatgtagctcgcaaatttttcaatttgcaagacttgcttggattcgataaggctagcaaaactgtggagtggttgctaacaaagtccaaatgtgctgtcaatgagctcgtccaaggcataaataaagaaaattgcgctactgctaatattggtgcaattagtacatgctctactacatctgagtgtgaagttgtatcaggaattgatgaatctacaaccactaatgatattcagaagcagtcaaatagaggtaaagtaggggagaagaagaaggctaataaactagttcgtagagctgcatttaatcctgtggcaaaggaatcaagaaagcaagctagagcgagggcaagggagagaacaaaaataaagaaaagctttttaaatattggtgatcagtctatggcggctgatgatttaaaacgattaggatgttggagtctttttgaaacaggtgaagaatcaggtattcaaggtactaatcatcaaattgaagaacacaccacgcaccacgaggagcctcttttggggactaatgagaatgttgatgattgtaatttggttgttaccggcaactggaacccatataccatcttcaattatcaccacagtactgaaatttctcacgaggtaggttttacacttcatttaaatccaagagtaattcttttagagttcaagattctgatattttttttggtggcgagaccctttcttatatcaaagcaaccttcaaggtacatacaagattggataaaccaattctgagctcgctccttgtgtaacatggcataagcagtcttggcaatgatgctctttgttgcctatggtttgtctccatttattcctctaataccccataaaaataataaaatataaattacatctacatgactggttttgaattatgataatgaacatgaagttacacttcttatgattttttcaagtacattgtgttttgattaccgcataaatatttaagcatggtcatcttttttttgattcatttgttgttagagtgactaattaatctgtagtatatgtctggaggcttgaggaatctgaaaaaatgtgcgtgtttgcatagttctttcaaaatagtataggacaatatattcttttaaaaaaaggagtccggtgcacaaagcatgtcgcattgttccgagtaaaagctgcacccaaagagtgtgatgcagacaacctactctaatacaagcattaatgaacgcgttgctccaaggctccggccccttcaatatatttctttatgaaccgtgaatttattcatgtttaaaagctttctttcaattccatcttttcttttgttctaacatttgttagtaaacgtgaatgaatgtagaggttcaagctagagaatgcaaaacagaaagcaatacattccctggattatgcattaccaaaccaccatgcagaaaagcttgtatcagtgagggatttactgatggtcattgtagcaaaatcctcagaaggtgcctatgcactaagccatgtgtgtttgatgagaagatgatcaaaacaggagctgaaacttttgctgaggaagcaaaaactttggctgcagctttgcttgaagaagagataatggataactaattagagattagaggaaaggattaattcagtgtcacacataataaagttgctgcctttcttaaaaggatagctaatgtattggcttttagtagcctttgttaccctaaaataagtgtgacatgtcaatccttttgatctagtaccaagtttatgtatgttttaatgaaaaatgatcttctatggtcattgcaatcccattatattccaagaacaaaacttcattattttcttggtcc

SEQ ID NO: 122 - DNA, 210 bp, Artificial Sequence
  Description of Artificial Sequence: Synthetic polynucleotide
atgaattcaaagaaaaacaactcaccaagaaaaaggttgagaaaatatcatacaagaaaagctcctattattagctcttatatggacatggctgaagctagaagagaaattgttcatgctttacaacttcatcgatcttcatcttcatctccaactccgtctattaatagcccaaagaagtacacattattgggtcaaggagttgtaagc

SEQ ID NO: 123 - DNA, 1575 bp, Artificial Sequence
  Description of Artificial Sequence: Synthetic polynucleotide
atgattggatacccaaaacgtttcaccttgcatggcctttggccggcaaacagtactggatatagtctaaaatgtgctccacctccagagggtaccagcgtgtggacaacagacggacagttacggacagctcttcaaaaatgttggtatagtctgatccggggtcgtcccaattacatactgtggaaacatgaatggaaggattatggctattgctctagtcatacaataaaagatactgactacttctgggctgcagtacgaaagcatggaagaaacaccaagattgcgggcgatgcgattgttaacgaattgagtgatgcagaaatcagtccgtcaaatgataaggaaaggagatgcgagactgaaagcgatagcagccatcactaccaacattctgaacaccatcaacgaagatggctgggaagacgacgagaatgcgacaccaaacggtactcccaggcaaagtatatcacctcccctcacgaaagcgtgacggcttcacgcgaaaagagagcatccacatccacaattgaggaagcaccaccagcagtgaagaaactattattagagtggctgacaagcactataaacaatatattcgacaaacctgcccaaaaggagaatggcaacaccgcacaagcagatatcgtaacaactactggcgagcagcctcttcctcggacaggtaacacttaccccactatggacgcaggggctaagaaggcggaagccagggtgaacgacatattcgctgttaggcaatcgtctggcgagggactcagagacttcctcgcccgatttaacagggaagaaatccacaatgcctattgcgccaaggagagagccgacgatgatgaccttaacggtccaatccaacggctgacatcggttcaagaagaatcgagaagtgatcatcgtaatgatagtcaaagggatcagtcgggcccccgtctcagccgagaaagacatcaacactacgtcagaacaaccgtcctgccatctcctcgacacatggaagggccgcccaggccgtacatagggacacagcgaaacgaaagaggtatgcctccactcttatccactcacaatttttgtgtttctccttcaaaaatagtgtacgcactaaagaagctcggcacgatggtgaaatgtccacaaaagatgaagtccggcccaaatactcagaagttgaatgccatttgtgaatttcaccaggaacgaggtcacaaaaccgaggattgcataggtttgcgacaagaggtagtgagaatgttaaaccaagggaacttgaaagaactgatgagtgatcgcggacgagtcaactttgcccgtggacgcgaactaccccagggacctcctaagcctccctctccagctcgcactatccaaatgatcatcggtggaggcgacgaagctatgatcaaccatatgaagttcaccaccacgcataaattgaaacggtcgatgacccacgaacggtacgacgatttcggagacagtatcatcttcgataagtcagataccgacggtttgacttttccttattttgaagctatcgttattactttatga

SEQ ID NO: 124 - DNA, 1032 bp, Artificial Sequence
  Description of Artificial Sequence: Synthetic polynucleotide
atgagttgccagaacagtaaaacagaagaaacggccgacgagcaacacaataccagcaaagaccctaaacacaaacccttctttgacgtttacggccctcaggggagggcagatattgttttcaatcaaccggaatccaattcaactttgaatcttcaagacgtgcaaggtcttgtcacatgggtgcttgctgatgggttcatgccgtcatgggcttttatcaaaaacaagcctttgatccctaaagtggttatgctgtatgttcctggccttgatgccgctctatatttgtcacagtctaaagtgctcaaaggtttcaaagaatgctgtggtattccgaggccagttttagctctgagctgtgtatcagatggaaatcagacaatagatgcactccttacgtacaaatcaaagaggaaaaggaaagaagctgagcacatttcaccaataaacaccgagccttctgaacaaggtgctgagactcccactatggagcctctatcttttgttgacctcaaaaaggatataccatttcccatcagttattacacacttacggataaggaactagaagaaaatggatactgttatgaccaaccagaatttctttcgacgctccctgctccttcaggaacatctccacatgaaattttggcccttgactgcgagatggttctgctggataaattggtcaaaccatcaaacaacattgttgactacaatactaggtatagtggaattacttgtcagatgttggaggatgtgactaccactcttaaagatatccaggaggagttcttgaaactggtttacaaggagaccattctggttgggcattccttggaaaatgatttgttagccctgaagatcattcataatttggtaatagatactgctgtgttgtacaaacatccaagaggatcctacaaagctgctcttcgcgttctgagcagaaaatttctcggcagggagatacaggactcgggcaatgggcatgacagcattgaagatgcaaagctacactggaactag

SEQ ID NO: 125 - DNA, 2172 bp, Artificial Sequence
  Description of Artificial Sequence: Synthetic polynucleotide
atggcctccacctcctacatcaccttcaaaccccttcaacaaactcaactcaaactctattacttcactcactgcagtaagcattcttcaactctgtttcactcttcttttcatactctcctttctgcaccaacaaaatacacactggaaccaccaagaattttgccctccattcaagttaaagcacatgtcactcacttggaaacaagattgtcctttgaaccagagcaagaaatatcaggcagtagaactaataatgaaaatagttctgggttttcttcctttagtcccaaagataagatggttggcatgaaatcttcaagagaaaatttagataggcactgtcaaactttagatgaattggtgcaattgttcaagagcagtgcagaagcttctaatacaaaaagtgtgagaggcgaacaggaagatcatggaattaaagtgagtgaagaagtgaaacactatgcacttaaatatggttttaagatatatgagaagatgcggtcagagaaggtacaaatgaatgaagcaacccttacatctgttgcaagaatggcaatggcattgggaaatggtgacatggcatttgatgtggtaaggctaattaaagaatatggaataaacccgaggctgcgatcttatggtcctgccttatctgttttctgcaataatggggatgttgacaaggcatttatggttgaagaacacatgttggagcatggtgtctatccagaggaacccgaactggaggcacttttaaaagtaagtgtagaagctggtaggagtgagaaggtgtactatttgttgcataagcttcgagaaggagttcgacaagtctcaccttctactgcagatttgattgagaagtggttcaacagcaagatagcttcaagggttgggaaaagaaaatgggatgaaagaaccatacgcgaagctattaaaaatggaggtggtgggtggcatggacaaggctggttgggtaatggtaaatggactgtatcacacgcatatgttgactctgacggctgctgcaaatgctgtggtgagaagctggtgactattgatcttgatcctgttgaaactgaaaattttgccaagtcagttgcttctatagctgcgcagagagagagaaattcaagcttccagaaatttcaaagatggcttgactattatggaccctttgaagctattgttgatggagcaaatgttggcctttatagccaaagaaaatttaggccatctagggtcaatgctattgtcaacggaattcgccagatgcttccttcgaaaaagtggccgctgatagttttgcataatagacgtattactggagataagatggatgaaccattcaatagagcgtactggctgtatgcagctataaaatttaagtgcttaattgtgacgaatgatgaaatgagggaccatttgtttcaacttctgggaaatgactttttcccaaagtggaaagaacggcatcaggtgcatttcagtttctctgaaacaggtccagtacttcacatgccgcctccctgttctgttgtaattcagtcatcggaaagatttggaccagacagaaggatatatcatggacggagtagcagaactttgaaagataaagaactatcagggtctcgggattcaggatatcccaggttatcggattacaatttcaatatcaatttgatagagttggtttcagttatgagaaacatcaaggaagcaaggttcccgaaaccaattcgatcatactccagtcaaaaggatcattttaaaattaagcgtgtgttggttgatccaggtagttctgccaatattatccaactaagggtcttagaacaagcaaagctaatcgaagttccgacaatgaagcttctggccgggttcaacctaacaagcgtaacgacccaaggagagatcgtgttgcctacatatgctgaaggggtgacgaaatccaccttgttcaaagttgtggatggcgatatgggctacaatgtaattatcggtaggccatggatccacaaaataaaagttgtgccatcaacttatgatcaatttctaaattttcctacatcagacgggattaagcagattagaggtgatcaacctgctgcaagggaaatgaatgttgtcaccttatctagcagtaatgcggaggaaatcaacaaatag

SEQ ID NO: 126 - DNA, 468 bp, Artificial Sequence
  Description of Artificial Sequence: Synthetic polynucleotide
atgcagtcgccggaatcttgcgtcatagtgagttgcccaactactctaatagccgacgaagatgaagaggtggcagatatggagacatctgttaaggcagtggaggaaatcttgaattacaaattcattaaaccaaaacttcttgaagaagcccttacgcactcttcttgcattgattctgtttcttatcagcgccttgagttcgttggagagcaggcggagttccatggaggagcaatgaaggcgccgaaggttcttgctgatattgtggagtctgtggcggcagctgtatatgtggattgtggctttgatctgaagaatctctggctgcttcttctgagaacaaagaaaatgctaacttcacgctgcaaggctgcactccaaaagttagcttttaaatctattggtaagacggatctgaagttgaaccaaatacagagattgatggggcaagcaaaagctgcatga

SEQ ID NO: 127 - DNA, 705 bp, Artificial Sequence
  Description of Artificial Sequence: Synthetic polynucleotide
atgaaacctcaaaaatcattgttgatcaaggttcttattacacaatgtttgttagttctttgtgttgcacaacaggactttgatttcttctactttgttcaacagtggccagcatcttattgtgatacaagacgtagttgttgttatccgactaccggaaaacctgatgaagattttagcatccatggtctatggccaaactatgaaaatggtaaatggcctcaaaactgtgatcgtgaaagctctttggatgagtcaaagatctcagatcttataagtacaatggaaaagaattggccatcattggcttgcccaagtagcgatggtgtaagattttggagtcatgaatggctaaaacatggaacctgttctgctcttggtgaacgtgcttactttcaagctgctcttgacttcaggaaaaaatcaaaccttcttgaaaaccttaagaatgcagggattacaccaaggaatggagaacattacactttagaaagcattaaaaaggcaatagaagaaggagtaggacacagcccttacatagaatgcaatgtggatacacaaggaaatcaccagatttaccaagtttatctctgtatggacaaaactgcaacagattttattgattgcccagttttcccacatggccgaggatgtggttccaagattgaattccctcctttctcctctgaccatgatgaattttaa

SEQ ID NO: 128 - DNA, 654 bp, Artificial Sequence
  Description of Artificial Sequence: Synthetic polynucleotide
atggcaactagaagacgagaggctgactttgatttcttctactttgttcaacagtggccggcatcttattgtgacacaaggcgtagttgctgctatccaacaacgggaaaaccagatgaagattttagcatccatggtctatggccaaactatgaaaatggcaaatggcctcaaaactgcgatcgtgaaagctctttggatgaatcagagatctcagatcttataagtacaatggaaaagaattggccatcgttggcttgcccaagtagtgatggtgtaagattttggagtcatgaatggctaaaacatgggacctgttcagctcttggcgaacgtgcttactttcaagctgctcttgacttcaggaagaaatccaaccttcttgaaaaccttaagaatgcagggattaatccaaggaatggagaacattacactttagaaagcattaaaaaggcaatagaagaaggagtaggacacagcccttatatagaatgcaatgtggatacacaaggaaaccaccagatttaccaagtttatctgtgtgtggacaaaactgcaacagattttattgattgcccagttttccctcggggccgaggatgtggttccaagattgaattccctcctttctcctctgaccatgatgaattttaa

SEQ ID NO: 129 - DNA, 483 bp, Artificial Sequence
  Description of Artificial Sequence: Synthetic polynucleotide
atgggtgtcactacctataaccaagaggtcacaacactagttgccccaactaggttattcaaagctttggttcttgattctgaaaaccttgtcccaaaattgatgccacaagttgttaagaacattgagattgtagtgggtgatggtgatgcaggaagcatcaagaagatgaactttgttgaaggttctcctatcaagtacttgaagcacaagatccatgttattgatgacaagaacttggtaaccaagtattcactgatcgaaggagatgttttaggtgataaactggagttcgttacctatgatatcaaattcgaagcttcaggaaatggaggatgtatttgcaagacttcaactgagtaccacactaagggtgattatgtgtttaaagaagaagaacactatgagggcaaaaagcaagccatggaacttttcaagactgttgaagattacctcctcgcaaatccttccgtctatgtttga

SEQ ID NO: 130 - DNA, 483 bp, Artificial Sequence
  Description of Artificial Sequence: Synthetic polynucleotide
atgggtgttgcaatttttacccaagaatttacatcccctatagcaccaattcgtttgtttaaagctctaattgtggactcaaagtccctcatacccaaactcttgcctcaatttgttgagagtgttgatttgttacaaggagatggtggagctggaagtatcgaacaagtgaacttcacaaaaggtagtccttttgagtttgtgaaacatagaatagatgaactagataaagaaaatatggtgtgcaaatacactatgattgaaggggatgcattggcagataagtttgactctatttcttatgaagtaaaatttgaagagtccaataatggtggctgtatttgcaagatgacaactgagtatattggaattggtgattttatcgtcaaagaagaagatatcaaggctgggaaagatagtgcaattggcatatataaagctgtggaatctcacctccttcaaaatccaaacctttatgcgtaa

SEQ ID NO: 131 - DNA, 483 bp, Artificial Sequence
  Description of Artificial Sequence: Synthetic polynucleotide
atgggtgtcactacctatactcatgaggtcacaacatcagttgccccaactaggttattcaaagctattgttcttgattctgaaaaccttgtcccaaaattgatgccaaaagtagttaagaacattgagattattgagggtgatggtggtgctggaagcatcaagaagatgaactttgttgaaggttctcctaacaagtacttgaagcacaagatccatgttattgacgacaagaacttggtgaccaaatattcactgatcgaaggagatgttttaggcgacaaactggagttcgttacttatgagatcaaattcgaagcatctggaaatggaggatgtatttgcaaaacttcaactgagtaccacacaaagggtgactatgtatttaaagaagaagaacacaatgaaggcaaaaatcaagctatggaacttttcaagactgttgaagattacctcctcgccaatccttcggtctatgtttaa

SEQ ID NO: 132 - DNA, 483 bp, Artificial Sequence
  Description of Artificial Sequence: Synthetic polynucleotide
atggctatcacttccttcactgatgagtacacttgtcctattcctccatcaagaatctttaaagcctccattattgattctcacaatttgatgccaaagctaatgccacaagctattaaaagtattgaatttgttcagggtaatggaggtgctggaagtattaagcaaatcaactttcctgaaggtggcaattttaagtccattaagtataggattgatgagcttaatgaagagaaatttgtttacaaatacactttgattgaaggtgatgccttggttgataaactcgaaaaaataacttacgaggtgaagtttgagcagtcagcagatggtggttctatctctaaggtgacaagcacatattatacggagggcgatttcaagctcaaggaagaagaaattaaagcaggcaaagagaaagtcttaggaatgtataaagcagtagaagtctatctcctgcagaatcctgatgcatatgcttaa

SEQ ID NO: 133 - DNA, 690 bp, Artificial Sequence
  Description of Artificial Sequence: Synthetic polynucleotide
atggcttcaaattcggccacttctctgttcttgacactatttcttattatacagtgtttatcactccttactgctgctcaagattttgactttttctactttgttcaacagtggccagggtcttactgtgacactaaacaaagttgttgctaccccaaaactggaaaaccagcatcagattttggaatccatggactttggcctaataacaatgatggctcttacccatcaaactgtgattctaacagtccttatgatcaatctcaggtttctgacttaatcagcagaatgcaacaaaattggccaactctagcatgcccaagtggtactggctcagcattttggtcacatgaatgggaaaaacatggcacttgttctgaatctatttttgaccaacatggctatttcaagaaagctcttgatctcaaaaatcaaattaatcttttggaaattcttcagggtgctggaattaaccctgatggcggattttatagcttgaacagcattaaaaatgcgattaacagcgcaattgggtatactcctggaatcgaatgtaatgtagacgagtcgggtaatagccagttataccaggtttatatttgtgtcgatggctcgggttcaaatctcatcgaatgccctgtttttcctaggggaaaatgtggctccagcattgagttcccaacattttaa

SEQ ID NO: 134 - DNA, 690 bp, Artificial Sequence
  Description of Artificial Sequence: Synthetic polynucleotide
atggcttccaattcagccacttctcggttcttgacactatttcttattacgcagtgtttatcagtcctcactgctgctcaagattttgactttttctactttgttcaacagtggccaggatcatactgtgatactaaacaaagttgttgttaccccaaaactggaaaaccagcatcagattttggaatccatggactttggccaaataataatgatggctcttacccatcaaactgtgattctaacagtccttatgatcaatctcaggtttctgacttaattagcagaatgcaacaaaattggccaactctggcatgcccaagtgatactggctcagcattttggtcacatgaatgggaaaaacatggcacttgtgcagaaaatgtttttgaccaacatggttatttcaagaaagcacttgatctcaaaaatcaaattaatcttttggaaattcttcagggtgctggaattaaccctgatggtggattttatagcttgaacaatattaaaaatgcgattagaagcgcggttggttatactcctggaattgaatgtaatgtagacgagtctggtaatagccagttataccaggtttatatttgtgtcgatggctcgggttcagatctcatcgaatgccctgtttttcctagaggaaaatgtggctcgagcattgagttcccaacattctaa

SEQ ID NO: 135 - DNA, 723 bp, Artificial Sequence
  Description of Artificial Sequence: Synthetic polynucleotide
atgaggtccatccaacttgttttggtcaagcttgttatctttcaatgtatcatgttattacatgctcaggattttgatttcttctactttgctcaacagtggaatccagcatcatgtgacagcaagataaaatgttgctacccaacaaatggaaaaccagcacaagattttggtattcatgggctctggccaaattacaacaatggctcatttccaaaaagctgtaacaaaaatgcccgttatgatgaaacgcagatttcggacttgataagtagtatgcagaagaattggccgacactatcttgtccatcaaacaatggaacaaggttttggtctcatgaatggaagaaacatggtacttgttctctttctatgctagatatgcattcttatttccaagctgctcttgccttgaaggaaaaggtgaacctgcttcaatttctcaataatgcaggtattaaaccagatggaggattttacagctatgaagcaatgaaagaagcaatagaaaaaggcattggacatactgttggtgtagaatgcaatattgatttatttgggaatcgccagctttttgaggtttatgtgtgtgttgataaatgtggttcggaaatcattgactgcccaattgtcccagaaagtaagagatgcaaagaaagtattgaatttgctgtcttcgaatcagaaagtctccttgatgagaaatctgcctattcactctag

SEQ ID NO: 136 - DNA, 798 bp, Artificial Sequence
  Description of Artificial Sequence: Synthetic polynucleotide
atgagatccatcaagtttgtcttggtcaagctcgttatctttcaatgtataacgttattagtacatgctaaggacttagatttctaccgccttaccctacagcagtggaatccagcagcatgctacaataggattataggtaaatgctgtaacacaaccacgggaagaccagcagaagattttggtattgctggactatggccatcttacaacaatctcacatatccagaaaactgtaataaggcaggcccttatgatgaaacgcaagtaagttttgataaaatacagatctcggacttgctgagtagtatgcaaaagaattggcccaaaatatcttgtccatcaaacaatggaactagtctgtgggctaaggaatggaaggaacgtggtacttgttctaggctcaacatgcattcttatttcgaaacagctcttgatcttaaggaaaagctgaacctgattcaagatgttaagcgttacggtacagatcttacacatgtgcatatgcatggactcgaaccaaatggacaattttaccactggcgtcacatcaatgcagccataaaattagctattggacatgtgatcgctatagaatgcaatcttggtttaactgcggacagccagttttacagggttcacatatgtgttgataaatctggttcggacttcattgactgcccaattaacctcaccgaaatctctgagacaacatgttcttcatctactaaatggtctggctacgatacagatagtgtccttgaagagcgatctgcctattcttgggcaaggaaataa

SEQ ID NO: 137 - DNA, 1482 bp, Artificial Sequence
  Description of Artificial Sequence: Synthetic polynucleotide
atggggtcctttagttttgcagtatgtgttagcttaatgttgctggttatggtggttgctattccttttgaacccaaaaatggcagaaggatagggcggctgcaccgctggtgggaccccttaatacgatcgccggtagatcgtgatgatgaggtggaagacagcaatagtgttcgttgggcagttcttgttgctggttcaaatggatacggaaattatcggcatcaggcagatgtatgtcatgcttaccagattttgaaaagaggaggattgaaagatgagaacatagttgtattcatgtatgatgacattgccaaaagtgagctgaatccaaggcctggagtcataatcaatcatccaaatggcagtgatgtctatgctggtgtgccaaaggactacactggtgagcatgtcactgctgcgaatctgtatgctgtgcttcttggtgataagagtgctgtgaaaggtggaagtgggaaggtcatcgatagtaaaccgaatgacagaatatttctctattactctgatcatggtggtccaggggtcctcgggatgccaaacatgccttttctttatgccaaagattttattgaggccttgaaaaagaagcatgcagcagggacctacaaagaaatggtcctctacattgaagcttgtgagagcgggagtgtttttgagggtatgatgcctgaagacttgaacatttatgtgacaacagcatcaaatgccgacgagagcagctgggggacgtattgcccaggaatggatcctccacctccaccagaatatatcacatgtttgggagacttgtatagtgttgcatggatggaggatagtgagtctcacaacctgaagaaggaaacaataaaacaacagtacgagaaggtgaaggaaagaacttccaacttcaacaactataatgctggatctcatgttatggaatatggaagcaaagaaattaagccagagaaagtatatctgtaccaaggatttgatcctgccactgcgaatcttcctgcaaacaagattgattttgcgcacttggaggttgtcaaccagagggatgctgatcttctcttcttatgggagagatacaagaagctagcagacaattcattggagaaggccaagcttcggaaagagataacggacacaatgctgcatagacaacatctagacgggagcgtagatgcaattggagtctttcttttcggcccaacaaagggttcttctgttctcaactctgttagaaaacctggtttacctctcgttgatgattgggattgcctaaaatcgacggttcgccttttcgagctacattgtggctcgctaacacaatacgggatgaagcacatgagagcatttgcaaacatttgcaacaatggagtgtctagagatgctatggaggaagcttttatggctgcttgcaatgagcataagatagaggagtatatcgctgccaaccggggcttcagcgcttga

SEQ ID NO: 138 - DNA, 1485 bp, Artificial Sequence
  Description of Artificial Sequence: Synthetic polynucleotide
atggggtcctttagttttgcagtatgtgtaagcttaatgttgctggttatggtcgttgctattccttttgaattacccaaaaatggcagaaggatagggcggctgcaccgctggtgggaccccttaatacgatcgccggtagatcgtgatgatgagtctgaagacaaggacggtgttcgttgggcagttctcgtggctggttctaatggatacggaaattatcggcatcaggcagatgtatgtcatgcttaccagattttgaaaagaggaggattgaaagatgagaacatagttgtattcatgtatgatgacattgccaagagtgagctaaatccaagacccggagtcataatcaaccatccaaacggtagtgatgtctatgctggtgtgccgaaggattacactggcgagcatgtcactgcggcgaacttgtatgccgtgcttcttggtgataagagtgctgtgaaaggtggaagtgggaagatcgtcgatagtaaaccaaatgacagaatatttctctattactctgatcatggtggtccaggggtgctcgggatgccgaacatgccttttctttatgccaaagattttattgaggtcttgaaaaagaaacatgcagcagggacctacaaagaaatggtcctctacattgaagcttgtgagagcgggagtgtttttgagggtatgatgcctgaagacttgaacatttatgtgacaacagcatcaaatgccgaagagagcagctgggggacgtattgcccaggaatggatcctccacctccaccggaatatatcacatgtttgggagacttatatagtgttgcatggatggaggatagtgagtctcataacctgaagaaggaaacaataaaacaacagtacgagaaggtgaaggaaagaacttccaacttcaacaactataatgctggatctcatgttatggaatatggaagcaaagaaattaagccagaaaaagtttatttgtaccaaggatttgatcctgccaccgcgaatcttcctgcaaacaagattgcttttgcgcacgtggaggttgtcaaccagagggatgctgatcttctcttcttatgggagagatacaagaagctagcagacaattcattggagaaggccaagcttcggaaagagataacggacacaatgctgcatagaaaacatctagacgggagcgtagatgcaattggagtctttcttttcggcccaacaaagggttcttctgttctcaactctgttagagaacctggtttacctctcgttgatgattgggattgcctaaaatcgacggttcgccttttcgagctacattgtggttctctaacacaatacgggatgaagcacatgagagcatttgcaaacatttgcaacaatggagtgtcgagagatgctatggaggaagcttttatggctgcttgcaatgagcgtaagagagaggagtataccgctgccaaccggggcttcagtgcttga

SEQ ID NO: 139 - DNA, 2307 bp, Artificial Sequence
  Description of Artificial Sequence: Synthetic polynucleotide
atgtacgatgatattgctaacaatagcgagaaccccagacctggagtcctcatcaataacccacacggtcaagatgtttatcaaggtgttcctaaggattatgtgggtgaagatgttaatgctgacaattttttcaatgttatacttgccaacaaaagtggtatcactaggggtagtgggaaaattttggacagtggcccaaatgacaatattttcatctattatactgatcatggtggccctggaattgtctcaatgccaactggaattgtctatgcgaacgatctgattaacgtgttggaaaagaagcatgcttctgggacatatagtaaaatggtattttacttggaagcttgtgagtcgggaagcatgtttgatggtcttcttcccgaaggtctaaatatctatgtcacgactgcatcaaaaccagatgaaaacagttggggaacgtattgtggtttgggtcgtggtgcttgtttagttgagtgtcctcctcccgagtttgacggtgtttgcttgggagacttgtacagtgttgcttggatggaagacagtgatgtccaagatcgacaaacttcaacgttggataaccagtatgacaggattgcatgcagaactgcagccaacctaacatatggttcccatgtcatgcaatatggtgatatggagttaagtgttgatgctcttttccagtatatgggttctgtttccacaagccatagtcaagctcccagtcccatggcagctgctcccagtcccatggatgccgcgtcattcttgacatcctcagaaaatgtgaaccaacgtgacactgaacttttctacttgacatccaaataccaaggtgctcctgaaggcactaacgaggaatttgcagctgatcggaagcttaatgaggttgtagcacaaagaagtcaagtggataacaacgtaaaacgtcttggagagcttctgtttggagtcgaaaaaggtaatgaggtgctgcagagtgttcgacctgctggacaaccacttgttgacgattgggattgccttaaatcctatgtcaagacattcgaggcacactgtggaaaattaaccgcgtacgggaagaaacatgtacgtggtatcgccaacatatgcaatgctggaattgagagtgaggagatggttgatgcaactgcacaagcatgttcagccgcctctgaaatcggccctaactctcctacttttactcaaactgattttattttacctccttctcacccactctatcttcatccttctgacaatcctgaccccgatatttcacaaagtgttatatactctaagtctgctaagagactatgggataaattgaaccaaaggtatgggcaagcaaatggtgctaagatgtatgaagttcaaaaagacctaagcactatatttcaaggttcttctgatgtaggaagttatttcactagggttaaaagactccaggatgaaatggagtcacttgatgctgattccttttgtgtttgcgaatgcaaatgtggaggtaaacacaaaatgatcaaaaggatggaaaatcagaaattgatgcagtttttgatgggtttgaatgaggagagaggatatgatccaaaaatgccatattgtagatattgtaaaaagccaggacatgtaattgagaagtgctataagttacatggatttccacgaccttcaaaatcagggaacaagaatatccgagttgctgcacatgtccattcatcttctgatgctaagcctaacaggtcttatgacaataacatcaatattgccaacaccatcatacctgatcaatacaagcagcacatgactatccttcaacatattcaagttggttctaatgattctcaaagccaatttgccacagctaattttgcaggtatttttgcttcatctgcccatctgatgagttgtggtaattgtacttgtttaagtagtgttctaacttctgaaacctggatactagattctggaacatcagttcacatgacatttaacaaatattcgcttacaaatataacaactttatatgttccctacctcatcacattacccaatgggtataaagtcaaagtgaccacaattggttctgtcaaattaaactcttcagtcattttgtccaaggtgctatatgtgcctacttttaaatacaatctcattttagtccataagttattagttgatactttatcattgctatgtttttctcaacatgcatgttttctactacatggcccttctctgaggatgccattgatacttggtaagtgtcacaacccaaaatctcacccatcgtga

SEQ ID NO: 140 - DNA, 1374 bp, Artificial Sequence
  Description of Artificial Sequence: Synthetic polynucleotide
atggttcaaaaaaatggtgttgtttcattcctagttgtactttttgtcatagtttgtactgctgagggtcgtaacttgttggagagtattgttgaagatgataatgcgactggaactaaatgggctgtgttggtagctggatcaaatgagtgggataattacagacaccaggcggatgtatgccatgcatatcaactactgaagaaaggaggtctaaaagatgaaaacatcatcgtattcatgtacgacgatattgcttataataaaaacaaccctagacctggagtcatcatcaatagcccccacggccatgatgtttataaaggagtccccaaggattacacaggaaaagattgtaatgctgataactttttcgctgttatcctgggaaacaagagtgctctaactgggggcagtggaaaagttgtggaaaatggtccaaatgattatatatttatctactacgctgaccacggtgctcctggccttattggtatgcctagtggagatgatgtctatgccgacgatctgatcaaagtcctgattaaaaaacacacttttgggatatattccaaattggtattttacatggaagcttgtgagtctggaagtatgtttgatggtcttctcccaaaaggtttgaacatttacgtaacaacagcatcaaagcctgatgagggcagttgggctacatactgtatttctttaggtgatgaagatgtagtctgcttaggagacttgtacagtgttgcttggttggaggatagtgatttgcacgatcggcaagttgaaactttggagaaacagtatcagctggttcgtaagagaactctaaataatggtacagtcgaaggctcccatgtcatgcaatatggtgatttacatataagtgaggatcctcttttcagatatatgggttctaattctgcaaaaaatagttactatagtacttctaccaacgatgagtcatggctaccctcaaggactgttaatcagcgcgatgttcatctcatgcacttatggtctaagttccggtctgctcctgaaggctctgctagaaaaactgaagctcaaaggcaattaagggaagctatatcacaaagagaacacgtagacaacagtgtgagacatattggagaagttttgtttggagttgagaaaggtcccgaggtgctgcagactgttcgacctgctggacaacccctcgttgatgattgggactgccttaaatcctttgtcaagatatttgagtcacaatgtggaaagctaactccctacggaaggaaacacgttcgtggctttgctaacctgtgcaatgctggaattcgaagggagcaaatggctgcagcagctaaacaagcatgtccttcttaa

SEQ ID NO: 141 - DNA, 1080 bp, Artificial Sequence
  Description of Artificial Sequence: Synthetic polynucleotide
atgattcgaaaaaatggtgttgtgccattcctagttgcactttttgtcctagtttgtactgctgagggtcgtaacttgctggagagtattgttgaagatgataatccgactggaactaaatgggctgtgttggtagctggatcaaatgagtgggataattacagacaccaggcggatgtatgtcatgcatatcaactactgaagaaaggaggtctaaaagatgaaaacatcatcgtattcatgtacgacgatattgcttataataaaaacaaccccagacctggaattatcatcaatagcccccacggccatgatgtttataaggagtacccaagtgggaaggttgtggaaaatggtccaaatgattatatctttatctactacgctgatcatggtgctcctggccttattggtatgcctagtggagatgttgtctatgccgacgatctgaacagagtcctgattaaaaaacacacttttggaacatattcaaaattggtattttacatggaagcttgtgaatctggaagtatgtttgatggtttactcccgaaaggtttaaacatatacgtaacagcagcatcaaagcctgatgagagcagttgggctacctactgtattcgtttaggtgatgaagatcaatgcttaggagacttgtacagtgtttcttggttggaggatagtgatttgcacgatcggcaagttgaaactttggagaagcagtatcagctggttcgtaagagaactctaaacaatggtacagaagaaggctcccatgtcatgcaatatggtgatttacatattagtgaggatcctcttttcagaatatgggttctaattctgcaaaaaatagttataatacttcataacaacgacgagtcatggctaccctcaaggactgttaaccagcgcgatgttcatctcatgcatttatggtctaaggtcaagatatttgagtcacaatgtggaacgttaactccctacggaaggaaacacgttcgtggctttgctaacttgtgcaatgctggaattcgaagggagcaaatggctgcagcagctaaacaagcatgtcctccttaa

SEQ ID NO: 142 - DNA, 1062 bp, Artificial Sequence
  Description of Artificial Sequence: Synthetic polynucleotide
atgataccggcaagaatggctgatgtatgtcacgcttaccaattactaaaggatggaggtctaaaagatgaaaacatcatcgtattcatgtacgatgatattgctaataatagggagaaccccagacctggagtcattatcaataacccacatggccatgatgtttacaaaggtgtccccaaggattatgtgcttgaagatgttaatgctaacaacttttacaatgttatccttggaaacaaaagcgctgtagttgggggcagtgggaaagtagtgaacagtggtccaaatgaccatatcttcatctattatactgatcatggtggccctggtgtggtttcgatgccaagtggagaagatgtttacgctaatgatctgattgatatgttgaaaaagaagcatgcttcagggacatatgacagactggtgttttacttagaagcttgtgagtccggaagcatgtttgatggtcttcttcctgaaggtctagacatatatgtcatgactgcatcagaacctaatgaagatagttgggcgacgtattgtggtgagggtactcctgatgatccctgcttggttgagtgtccccctcccgagtttcagggtgtgtgcttgggagatttgtacagtgttgcttggatggaagatagcacaattgatagacttctttttcttacaccacacgatttctattcatttttttctgaatgtttgcagcaccaaaatgcccctgaaggctctgatgagaaattcaaagctcatgcgagacttactgaagctatatcacagagaactcaagtggacaacaatgtaaaacatcttggggagcttctttttggtgttgaaaaaggtaatgagatactacacagtgttcgacctgctggacaaccacttgttgacagctgggattgccttaagtcctacgtcaagatatttgaggcacattgtggaagattaacctcgtatggaaagaaacacatacgtggtatagccaacatctgcaacgctggaattgcgagtgaacaaatggctgctacatctgcacaagcatgttcaagttag

SEQ ID NO: 143 - DNA, 1452 bp, Artificial Sequence
  Description of Artificial Sequence: Synthetic polynucleotide
atgattgttcgctacgttgtgagtgctgtcttgatcattggactgtcaattctcgccgccgttgagcagggatgtgctgaaattaccgtcggaagcattaaagttttcagtggtgagtacgatgatgattcaattggtactaaatgggctgtgctggttgctggatcaagaggttgctggaattacaggcaccaggcagatgtttgtcacgcatatcagctgttgaagaaaggtggcctcaaggatgaaaatattattgtgtttatgtatgatgacattgctcataatcctgagaatcctaggccaggagtcatcataaatagccctaatggtcatgatgtctataaaggagttccaaaggattatacagggcatcatgttacagccaacaacgttcttgctgttatccttgggaacaaaagcgctcttagtggaggcagtgggaaggtggtggaaagtggtccgaatgatcatatcttcatcttctacagtgatcatggtggtcctggagtgcttgggatgcctagtggcccttatctctatgctgatgatttaattgatgccttgaaaaggaagcatgcttcagggacatacaaacgcttagtcttttacattgaggcttgtgaatctgggagtatatttgagggccttctacctgaaggtcttaatatctgtgcaacaacagcatcaaatgctgaagaggacagttggggaacctactgtccaggagactatccaggtcctcctccagaataccagacctgcttgggtgacttgtacgctgtgtcttggatggaagatagtgaaaaacacaatctccaaagagaaactttaggaatgcaatatgagctggttaaaaggagaactgccaactcgtttccctatgcaagttcccatgtaatgcaatatggtgatctgaagctaatggatgatcctctttccctttatatggggaccaatcccgcaaatgataattacacttttctggacgagaattcctcactgctctctgcaaagcctgttaaccaacgtgatgcagatcttttgcatttctgggacaagttcctcaaggctcctcaaggttctattaggaaaattgaagcccagaagcagctgactgaagctatgtcacacagaatgcacatagacgacagcattgcacttgttgggaagcttctattcggaattgagaaaggtcctgaggtgctgattagagtcagacctactggcgagcctcttgttgatgattgggattgtcttaaatcctttgtaagaacatttgagacacattgtggatcattatcccagtatggaatgaaacatatgcgtgctgttgctaacatatgcaactctggtataaaaatggagcagatagccaaagcatcagcacaagcttgtgtgagtattccttccaactcttggagttcgctcgacgagggatttagtgcatag

SEQ ID NO: 144 - DNA, 474 bp, Artificial Sequence
  Description of Artificial Sequence: Synthetic polynucleotide
atgagctatggtgaccaatcacaaactattggtgaccttgcttttgagaaattcacatttccttctatttttggaaataatgttaacattcttgatgttgtctttggctgcggtcatgacaatagtggcacgttcaacaactatacttctgttattattggcttaggtggtggtgaagtttcaattgtcaaccaattggataaagaaatcaatggaaaattctcttattgtttaatcacaattccattacaatcatcaatttctaatgccaccagtcacataaattttgatgcagatttagagttgtcgccttcgagcacgtttgcagaagtggaggaagatttggtttctcttacaatagtgccagcagaggaagttgccatttttggaaacttggagcaggcaaatttcctaattggatatgatcttgttgccaacaaaatctcctccttgccaacagactgcactagctaa

SEQ ID NO: 145 - DNA, 867 bp, Artificial Sequence
  Description of Artificial Sequence: Synthetic polynucleotide
atgattaatagtcgacaccgtcgaaaatatggaagtaaagatgaatggaatatgcgatttgggatttatcaatccaatgttcaatttatcgacttcttcaattccctcaacctttcttacaacctcactgacaatgcttttgcagatatgacaaacctcgagtttaattctaaatatttaggttataagaaacgtaaacattcaaagcaattagcagcaccaaatatcacgtgtgacagctctaaattgcctatcagtgtcgattggagaaagagtggagttgtaacacgagtcaaggatcaagaaaattgtggaagctgttgggcattctctgcagtagcagcagttgaaggcataaacaagatcaaaacagggaaattagtgtcactatcagaacaacaactagtggactgtgatgttttctcagacaaccaaggatgtaacggaggattcatggaaaaagcttttgctttcattaataaaaacggtggcattacaactgaaaaaaattatcattacgtaggaaaagaccagaaatgtaacactaccaaagcaaaacaacatgcagttacaataagtggctatgaaatggtagccaaaaatgaggaatctcttcaagctgcatttaccaaacaacctatatcagtggccattgatgcaagtggctatgattttcagctttgcgctggtggggtttactctgtttttttcggaaatagcctaaatcatggagtgccattaattggctatggtgtagatgatggtgagaaatattggctagttaagaattcatggggtactatgtggggtgaagatggttatatcaaaattaagaggtggtcaaatgacaaaaaaaggaacgtgtag

SEQ ID NO: 146 - DNA, 2121 bp, Artificial Sequence
  Description of Artificial Sequence: Synthetic polynucleotide
atggccaattctctcctctcttccaacttcatgggttctcaaatctttgtctctcctcccacccctaaaacaacaaagtatttccattttcactccaaaagaaagtctttaatccctcaatcaattctcaacaaaaaacccaattcagataattcaaagaatattccttcaaaagctgctttagctgctttactcttttcttcaatcactccacatgcctatgctcttgataatactacccctacagtaccaacccctcaagtgattcaagctgaagcagccaatcccaccacttcaaatccattctctcaaaatataatcttgaatgctccaaagcctcaagcacagaccaatcctgaacttccagaagtttctcaatggagatacagtgagttcttgaatgctgtaaagaagggtaaagttgaaagagtcagattcagtaaagacggaactacccttcagcttaatgctgttgatggccgtagagctagtgtaattgtgcctaatgacccggatttaattgacattttggctatgaatggtgttgatatatcagtttctgaaggtgattctggtggtaatgggttgtttaatttaattggaagtttattcccttttattgcttttgctggattgttctatcttttccagagatctcaaggtgggcctggtgggcctggtgggcttggtgggcccatggattttggtagatcaaagtccaagtttcaagaagttcctgaaactggagtgtcttttgctgatgttgctggtgctgatcaagctaaattggagttacaagaagtagttgattttttaaagaatcctgataagtatacagctttaggtgctaaaataccaaaagggtgtcttttggtggaccacctggtacaggaaagacacttttggctagagcagttgctggtgaagctggtgtaccatttttctatgtgcagcatcagagttgttgagttgtttgttggtgttggagcttctagagtgagggatttgttcgagaaggcgaagtcgaaagcgccttgcattgtgtttattgatgagattgatgctgtgggaaggcagagaggtgcaggaatgggaggtgggaatgatgagagagagcagactattaatcaactcttgactgaaatggatggtttttctggaaatagtggagtaattgttttggctgcaaccaataggcctgatgttcttgattctgcattgttgagacctgggaggttcgatcgacaagtgactgtcgacaggcctgatgttgctggtagaatcaagattcttcaggtgcattctagaggaaaggcccttgcaaaggatgtggactttgagaagattgccaggagaacaccgggtttcactggtgcagatttgcaaaacttgatgaatgaagcagcgatccttgcagctaggcgtgaactaaaggaaataagtaaagatgagatatctgatgctttggagaggataattgctggaccggagaagaaaaatgctgttgtctcagaggagaagaagaagctggtagcttatcatgaggccggccatgccttggttggtgcacttatgcccgagtatgatcctgttgccaagatatctattattcctcggggccaagctggtggtcttaccttctttgcccctagcgaagaaagacttgagtcgggcttgtacagcaggagctacctagagaatcaaatggcagttgcacttggtggaagggttgctgaggaggttatttttggacaagacaacgtaacaactggggcatctaacgatttcatgcaagtttcacgagtggcaaggcagatggttgagagattagggttcagcaaaaagatcggacaggttgccattggaggaggtggaggaaatcctttcctaggtcaacagatgtcaacccagaaagactactccatggcaacagccgatgtggttgatgctgaagtaagggaattggttgaaagagcatatgaaagggcaacacagattatcacaacacacattgacatcctacacaagcttgctcagctgttgatagagaaagaaactgttgatggtgaagagttcatgagccttttcatcgatggcaaggccgagctatacatttcatga

SEQ ID NO: 147 - DNA, 2238 bp, Artificial Sequence
  Description of Artificial Sequence: Synthetic polynucleotide
atgattatagaggtgctcatattgtggcatgcagatgttaggcataatatatctctaactgcactcagctctactcagtccttttacaaagatgacctttacattgttttcttgaaagatcatccggtgaacgaagaatcgctatttcagagacatattattgtcctatcatctttaaagggaagtgatggggctgcaacagaatctcatgtttatagctatacaaaaatcttcaatgcatttgcagcaaagctatctcaacatgaagttcacatgttatccagcatggatgaagtggtttctgtcataccaaacagatacaggaagctacatactacaagatcatgggaatttattggtttgcctgcaactgcaaaaagaagattgaaaagggagagcaacattatcgtgggtgttttcgatacagggataactcctcaatcaaaaagctttaaggatgatggtcttggtcctcctccagtaaaatggaaaggaagttgtggccattttgcaaatttttctggatgcaacaacaagcttataggagcaagatacttcaagctggacaaagttcctgatccaaatgacatattgtcaccaattgatgtgcacggccacggaacacatacatcatccaccctagcgggaagtatggtgcctgatgcaagcttgtttggtcttgcccgagggactgcacgtggagcggttccttctgctagagtggctatgtacaaagtctgttgggtgacctcaggttgtgcagatattgacattctagctgcatttgaagctgcaattagtgatggtgtggacttaatatccatctcaattggtggtctcagtggtagttatacaactgatgtgatagccattggatcatttcatgccatgagaaaagggattcttactgtggcttctgctggaaatgatggacctaacctcaacaccgtcgcgaaccatgcaccatggatgctaactgtagcggctagtggcattgatagggagttcaggagtaaggtggcgttgggaaatgggagaatagtctcagggattggagttagcgcgtttgatccaaagaaaaaattgtatcctcttacggcgggagtggatatggccaagagctctgacactcgagacagttcaaggtactgtggtgaaggatcaatggatcctagaaaggtaaagggaaagcttgtttattgccagttgggtacttggggtgctgattctgttataaaagaacttggagggatcggcactatcattgaaagcgatcagtttcttgattctgccccaattttcatggctcttgcaacaatagttaattccagcatagggaaaaacattaataactatatgcattcagagagattaccttcagcagtaatatacaaatcacaggaagttaagatcaaagctccatttattgcatcattttcatcaagaggtccaaatccaggaacaatacgccttctgaagcctgatattgcagctccaggaattgacattctggcttcttacacccccctgaaatcactcactggtttgaaaggcgatactcaatattcagaattcaccctcatgtctggcacttccatgtcatgccctcatgttggcggtgcagctgcttatgtaaagtcataccatccagattggtctccttctgctattaagtctgccctcgtgactactgcaagacctatgagctcaaaggtggacagggaagcagagttcgcgtatggtgctggacaagttaatccgacgaaagcaagaagtcctggattaatttatgacatggatgatatgtcatatatccagttcttatgccatgaaggttacaattcatcatcagtatccagtttacttcgacaacgggtaaattgctccacattgattcctgcaaatggtgaagatgctatcaactatcccacaatgcagcttggcctaaagagtaatcaagaaccaaccattggcattttcaggaggaaagttaccaatgttggacaagctatatctgtttataatgccactatcagagctcctaagggagtggatatcacagtaaaaccaacgactctctcattcacacgtgcaatgcagacaagaagtttcaaggttgttgtgaaggcaaaaccaatgtcaaatgctgtaatattgtcaggttcactcatttggaagagctcccgccatcttgtaagaagtcctattgtcatatatgatccaaaggtttttgattaa

SEQ ID NO: 148 - DNA, 5000 bp, Artificial Sequence
  Description of Artificial Sequence: Synthetic polynucleotide
aaaaatatgagaatcgtgcggaatttcagttttatggaactaaaacgccaaaaatggaggaacggtcatggagaggcgataactaatgttccttaggtttttttagatgggccgaaaaaattttaggcgatacgggtaaggcgtccgaaacacacgaaaatttgaaaatcgggcgaattcttgttttatgacactacaacaccaaaaagtatggaagattatggcgatgcgatgcgatgaataatgttccttaggttatttttgatgggtgacaacattttaggttatacgagaccgggttcccgggcccacaccagtggcgtgggctatattgcacacgaaaatatgggaatcgagcgaatttctacatttatggcactaaaatgcaaaacaaaaaggaacagtcatggcgaggcaatgactaatgttcctagggttatttagatgggccggaaaagttttaggtgatcctggtcgtggcgctcgagcccacgatggtagtgtgggcacacgaaaatctgggaaccgtgctgaattctagttttatggccttaaaacaccaaaaccaacaaagaggaattctcatggaggggcgatgaataatgttccttaggttgttttagatattccagaaagattttaggtgatccgggttgcggtgcctgggcccacacccagtggggtgggctatagcgcatgcaaatgtgggaatcgagcggaattctaattttatagccctaaaacaccaaataatgttgaacggtcatgacacgatgatgactaatgttccttaggttatttttgatgggctagcaaaatgttagaagattcgggtccggctgcccgggcccatgccagcacaagaaaatctgggaatcaggcaaattccatattatggcgattatggcgaggcgatgaataatattacttagattgttttttacaggctggcagaattttaggttatccaggtgcgggcgtctgggcctctgccggtggcgtgggctgtagtacacaaaaattagggaatcaggtagaattttagttttatggccctaaaataccaaaaaaggaggaaaagtcatggcgaggtgatgactaatgtgccttaggtaatattttatgttccgaaaaaaatttatgtgattcaggtccgggagctcgtgcccatgcagatggcgtgggctatagcacccgaaaatctcaaaatcatgtggaattccatttttatggccataaaatgctaaacataaggaacggtcatggagaggcgatggctaatgttcattgggtcgtatttgataggacggcaaaattataggcgattcaggtccggcgccgggcccatgcagatggcgtgggctaataatagcacacgaaaatctgagaatcgggtggaattcatgttttatggccctaaaacgcaaaaaacaaatgagaaacggtcatggcgaggcgatgacaaatgttccatgagtcatttttgatgggccagcaaaagtttaggcgattcggtttcgggggcccgggcccatgcagatggcctgggctattgcacacgaacaactaggaatctggtggaattccacttttacagcaataaaataccaaacaatgagaaacggttatggcgaggcgacgactagtgttccttaggtcggtttagatgtccggaaaaataataggcgatcgggtccaggcgtccgggcctgcgccaattgcgtgggccatagcatatgaaaatatgggaatcgggtgaaattcgagttttatggccctaaaatactaaaaaggaggacggtcatggcgaggcgatgattaatgttccttaggtcactttttatgggcagacataatttttggcgatctgtgtctgggagaccgaggccatgtaggtagcgtaagctatagcacacgacataattccaggtttatggacctaaaacatcaaaaatggaggaacggtcatggtgagccgattactaatattccttaggtcgttttggatgggccgaaaaaatttagggcgattcgggtgcggacgcccgagcacatacaaatggtgtgggctataccacacgaaaatctgattacctgacagaattccagttttatggccctaaaatgccaaaatcgaagaacggtcatggtgaggcgatgactaatgttcctaaggtcgttcttgatgggccgacaaaattttaggcgattcgggtgcggacgcccaagcacatgtagatggcgtgggctataccacacgtaaagcagggaatcgggcggaattcaagttttatggccctaaaacgccataaacgaagaacggttatggcgaggcgatgactaatgttccttaaatcatttttgatgggccgtcaaaattttaagcgattcgggtcagggcgccctggtccatgcagatggcgtagcacacgaaaatctaagaattgagcagaattctagttttatggccttaaaacgccaaggaacgaggaacggtcatgtgaaggctatgattaatgttccttaggtcgtttttaagggcaggcaaaactttaggctattcagttctggacgcccagacccatgtagatggcgtggctatagaacacgaaaatctaggaatcaggcggaattccagttttatggtcataaaatgctaaaaatgaggaactgtcatggagaggcgacaactaatattcgttgggtcatttttgatggtccagcaatattttagatgattcgggtttgggcgcccgggcccatgcagatggcatgtgctattgcatacacaaatctgtgaaccgggtggaattcaagttttatggccctaaaatacaaaaaaatagagaaacggtcatggcgatgcgatggatatgttccataaggcatttttgatgggatagcaaacttttaggtgattctggtccgggagctagggtctatgcagatggcgtgggctattgcacacgaaaatttaggtatcggtggaatttcagttttatggccataaaatgcataaaatgagaaacggttatagcgaggctatgaccagtgtgtccttaggtcgttttagatgggctggcaaaatgttaggcgatttgagtccgggtgcccgggcctgcgccaattgcgtgggtcatagcatacgaaaatataggaatcggacgaaattctagttttatggccctaaaatactaaaaaggaggaactgtcatgacgaggcgatgactaatgtttcttaggtcgtgtttgttaggccggcataattttaggcgatctgggtctggacgcccagggtcatgcaggtagcataggctgtagcacacgaaaattttgaaatcgggcgaaattctagttttatggccttaaaacgcgaaaaacaaaatgaatggtcatggagatgcgatgactaatgttccttaggtcgttcttgatgggacggcaaaatgttaggcgattcgggtgtgggcgcctgggcacatgcatatggcgtgggccatcatagcatatgaaaatatgggaatcgggcagaatttcagttttatggccctaaaacgccaaaaacgaaaaacggccatggcgaggtgatgactaatattccttaggtcatttctgataggccggcaaaattttagacgattcgggtaaggacgccctggcccatgcagatggcgtagcacacgaaaatctgggaatcgagaagaattccagttttatggccctaaaatgcgaaataacatggaacggtcatgtcaaggcgatgattaatttttcttaggttttttttgatgggcaggaaaaatattaggttatgcccatgcagatggcgtggctatagcacacgaaaatctgggaatcgggcggaattctagttttatggccctaaaacgccaaaatgtgaggaacggtcatgtcaaagcaatgattattattccttagttcatttttgattgtcggacaaaatgttaggcaattcgggtccgttcacccggatggatgcatatggtgtgggctagtacacgaaaatcttggaatcggacggaattccagttttatggctttaaaacgccaaaaaataagggacggccatggcgtagcaatgactattgttccgtaggtcatttgtgaaggaccgacaaaattttaggcgatccgggtccgatttttcggttctgctcaagaaaactcgatctgcacgaatagcttataatcaaacccttttttttttttcaagaatgtctaattgatcctaaaaagacaaccttatatgttccaccatggcaggatcggccttattactaagggtttgccaatagacacgtttttaacattcaagtaaaaaaaacatttattcttaataacccacctactatagtacgttatttggcagtagactacgttgtacatttgggaccatttggaacactcgtctttcacgagtcactaatttttgtgttgaatgcataaaatttgtttttttctttttcgaaattgaacaattttatcttcgatcacacctatagtatattattaccttattgttagaaaatattttattttattattgactcctaataaaaagtggggtaaatttgggtcttttttttaaagaatgtgaactactcatttcactttggttagaacaaatatgagaagatttgctaatgacagcaaaatgaatagaccaaaagcgtaacgaatattaaaaataaacaattccgaataactggttactgaaaattgtggaactctacatagccgttgtgagtatggtattgtttgttcttgtgggcagaataactagttacggaaaatttatgaatttgcttcacattatttttttcattttcttttttgcttcaaaagataagtacaagtttttatactcttatttcattgcctataaatacctctattgagttactgctcattcacaactctaaatagcaatctttcttattattaaaattcctatccttttttactcattcagagaaacg

SEQ ID NO: 149 - DNA, 5000 bp, Artificial Sequence
  Description of Artificial Sequence: Synthetic polynucleotide
gctgatctacaaagggcttagaaagaagtaagaaaagaaatggataaaggaaagggaaagattgcagaatcctcagagctgttgaggaagaggagatggaactggtccatcaagaaaggggtacatcagtggaggttcctaccccaagccaaaaagcccaagacttcctccaagaagtcttcctctgtgtctgaggctgttgaacctacactagccaagaggacaagatctgcagtgaaaacaacaatcaaaaatttctgaagatgatgactggagtggagaagaagaagaaaatgattctgagaaggaacaggatagcttgccagtttggcaaaagaaagattttaaagggtagactgctgaaagacctggtggaaccaggaatgatgagatgtggatgctttagctgctcaggatggaaggacatggtccttcagatggatggtaggctagccagaaatgagctaattgaatttatggcaatgtctggttaaggatggcatgttagtagcctggtgaaaggagttcaagtgcagtttgatgcaaagaaactgggagagatcctggacataccctctgaagggtttgatgactatacaaggcaaaggtggccctgcctggactccctccctactgctcttgtaattaccaggaggttttgtgattctgaagatgtgaatgaagccagggctgtgcagaaaagtgaaatgaggcctgagcacaaggacttgtttgaatttgtcaacaagtgtttattgcccagacaggagagaagtcacattgccaattacatggatctagttcttatagagtgcctggagagaggaaagcaaatcaattgtctgccttcattatcaagctgctcgacagggttataaatggctccaaggctcatgctactctttatggctttattctaaccacagttctggatagtctcaatgtgcctctaaagaaatgggaaatgatctcgagaaaggatcactttggcatcaatactcttcttgcttgtgactatgcagtcaatgacatcccaaatgaacctggtacatcctagaagacacccatcaacagcaaagtcaggactctggttcaggaatatgtagccaaggatgctgaaatagctaggcttttggctcgtgtgattgaagtgaaatttgagagggatggtctcagaactgagcttgacaaagaaaaggagaaaaatgatggaattcttcataacatgctgaaccttctccaagcccaaacccaaccatatagttcttccaagccttaggactcctagcttttgtctcctgaacttgtttagtacctcagtgacccagattagggatttttctatcttttatttttgctcatgatttggatgtttttctttctttttgtggattgttggtggcaacatatctctgtcaatgataactactattttgctcttgtttaatgttaatttgtccttgatattttaaatatattttcttgattactgatgattactccatgattacatttgcagttgccgcagtggccatgggtacttattaaaatctgggaatcacactttgtatgtaacatttcgatgatgccaaaagggagaagagagttgtgctttacacacattctgaaataagtaatatttataacctaattaacctggtccttgatgttaagtgaattttctaagtttagtattgatggttaagctgagttcttacaggtcccaaataagtaaaaagcacagagtttgtcatcatcaaaaaggggaatttgttggcccaagaacaggtgaagttttgaagatgacaaaagaactcagacatggaccaggtccatcttgtgaagcacagtcatgatcaacctatacatgtgagatgcacgtgaaagagataagtcttactgattaagcaacaatatctcttgatctgatcgaaaaggatgaagatagtgttagagtttgagatcatcatgaactcttccacgatagaagagcagcaattgagtcacaatcaaactctgattactaacctattaaatgtcagtttgttctcttttacaggaaatacacatacgcaaaagttaaactaaattgagagcaaaagagcaaggcgattttgcaagcaatttatgtggatttgagtgtgcactcctgaagctacttgaacgagatagaagaaccagttccatcgtgtctatctttttctagttcaattgtagtaggtggtttaaattatacctttcagctttcatagaagcaattgtattagatacctagagtgttcaagttatagctaacttgaagttgtcgcaacagttgaggttgtgtgccacaacgggattagagttaatccttaggtttataaagagtttttgtaaaagctattttggctcagtgattttagtggaagtttgggaaaatcctactgagttgtaggtcatggttttttcaccttttgagccaggtgttttccacgtaaaaatctccgtgttctttatttctgtatttattattccgcaattagtagtagttggaacacctagaaaaccaagttcttctatagagtagttaagcgaaaattgggtgccacacaaacacccctctagtgtggtattgacgcttaaacatcaattagttaatttctggagcaactagctactagttgttattaaaatagttagtttctttgttagctaatatgttgttttggttgtaaattagttccggtgtgtagtttggactttggaagaagacttgtaccaattgtgtttgttattttctttggtcttatgaatgctcacactaaacatcaagttggtatttgattttgcatttgaattagaagtagtattgagacgtgttgttgctatgcataagtagtaaaagattggtttgagcttagttggtttcgtgataagattggaaataaaagaaatgtgtcaaagttatgtaaaaatcagtaaaataggctgctaccttttaatattaccacaagtccacatttattttagttttaaacaatataaatttgttaaggtaatcttcttacaatagtctcaacttttaatttagtaacagataattgcaaagtcaatccaactaatcatacactacccatatgtaaaaaaaaaaaaaaaaaaaaaaaaaaaaaaaagtgaacaatcaatgcacaaaaagaaaaaaaaatatttttcttctttaattaattccataacatagtccttaaaattagttaattcttgttttagaaaaattgtaacagtctagttaattctccaaaatgaagcaaaagattttttttcttaagtattacgtcactttttttattaatccaccaaataaattaaattagatttagttcactaaataaactcaataagatcagatgttttatttattttaaaaataactcaattacttaatcacaaatgatcatgactaactcaaaagtaatttgttttaacaaaaataattaatttcgtcttaaccgatgtcgggacgactcattttggaataaatacataaataaaatggccaggtcgcgaggacacgtcatattccaattctttcaaataagcttgttatttattaacttgagtaggctccaattttaggtgcggcgcacgaactaaggtcggagatattcatcttggttagcgtaagctagggttggggatattcgtcctagtttgagattaattaagtcatcaacagtaaaagtggacataggcaaaacatgaaaaccgaataaagcacaatttatccataattaattcatgccaaatttaagttaataaagcaactgtgctagaaccacggactcggagaatgctttacacttctccccgatcaacaaaaatctttattcggactttatttttgcagaccgataataatagagtcaaatcttcctttgactagggattcaaataaaaagtgacttggaacatgcaaaaatcaattccaagcgggcgaatctgtaaacaaaaaatccttattcaaatttgtcactttaattgaaaaactctttaacccactattcataacatatatatttttggggtagaaaaggggttgacagttatgacctactttatgcatcagtgttcgaatttattttgatcaacacccttttggaagagcgtttgatagaaatggttggcttaataaacaatcatattatcatcacctgcggaatcatatcattaacttttgaaaattaaaatggttttcaaagacgttttgataaaagaattcctattgtcgcagttggaatctacaagaccaagatgttgatctagtgctatatttggagaaagtgccttaattaaaaaaaattgttcattagttgtcttaagattttttattatttaaaaaaaaattaagacacaaagaaacacatttacgagtatatgtcggccgactaatgtgaagttcccacggacaacccacacatattgtggtcaagatggattctatcataatcaaaagtcatcatcaattcaattctcatatttggcatctcaagtacatgcacaaaagcaacttaggatgtaagtttatatgcacattcttgaaatagaacctatttatacgtagtacttaattagttacagtagtattatttattctctgctacagagctatggtttatcaaatatatcagattatcatttgttgtgtaggccatttccttatttgtacttggtattaattctggcaaaagcacaaaactgggaaatgaggttcttcttccttaatatgagtcacagattagtaccactactatagccaagaaaatgtgaaatcatatagtactaaatattaatttcagatgccaaaaccataaatttcccctcctccatcattgaaaacccctctgtcctttcccctagagagacccctttttcctctctctctccttctctttttattagacgcatatattctctcttctttctctttctagggttttcacctgaaatagttttatttcggtgat

SEQ ID NO: 150 - DNA, 5000 bp, Artificial Sequence
  Description of Artificial Sequence: Synthetic polynucleotide
atttaaaaccctaaaaaacaagatttttatctatctgcatggtgaaggacaaagaggtcttcaatctcaggttcttttttttttttttttttatatatatatcttgtttgggtttaaggttattgggctgatgaatgttttaattttaacataggtctacttacgtagtagttataggttgataatgagatataattaactaagtctttgtataatgcagatcctgaacttaatctttatttgtattatttttttttgttactgaaagattctgttaccaaattttatcagtctatttaattagaggccaacgattgttaggtatgtggcacttcgagtgggaaatgatatattcccattaaaggtgttaattaaccaccaaattgttctttaggtctgtttgtcattttgtattaaggtggatggtttattatatatatcttctctttaatgctaatcatgcttaactttttcatttagtaccagcaagcatatttgtttactttattggttattccttatcaaagtcttcatcttgttgcttttttttattgtactttacaaaagatttctagtattaatggaaagtgctcatatttggaaaaagacatggccaacaagaaatgtctatataccccatttcttcttcttcttctttttttccgaaaatttcttatttttgtttttatttctgtttcttgttgagtgctttcatggtagaagaagaagtaggagattcttggacatggctgcatgagaattgttaaataaccccgtatacatacacaagtagtgttggctgtctttgatatcaaaccatttattgccctaatttctgccttttgtcccctcaacaaaaccatcaaagttctcaaagagggtttattcttgtttcccactttgccccccacctattagggccaccccaccaaagggatctctctcgtgtctagtgttttttcccaaggaccaccactcctttttttttctctaccataacttcgtccacaccatcttattgtgatattttcgtttaatgaatttgcagccatgccttcattcatcatcagaactcagtcataagcacagattctgagagagtaattaatgaatgaatcagtggtgatttgacgtaaagtatacatgattatggtttttagctgaataagcagagggagaaaatatatacatatataaacaagtagagtaaaagaatgacgcaagattagtaccaaaagagtgaaggaagagatttaatattatagggaaaagggaagtagtaggtgatacttgacaggttgataagatggttattactacaagttgatgtattgacgctaactcacgcaagagagacctactcactgtacaatatttttacaagaataagcgattctttctctctttacttgcaagaattgtgtgttgtgtgagttgtatggcgcattttctaggagcctgtggtagtgatggatgtattcatataatacaatacaatacatatggaatagatagatagataagatggtgcacgcatgagaggcaattatgcaacttacgtcaactacttccatccatccatcttttcttccttctgtttctgtctgatatagtgagtatatgcttgtgctggtgttgtgtgcttttctggcctgggattttcctaacactttagataatttaggttcccatcaataataatgtctttttagaggagcatcatcgatagatattcaaatattaaacctggcctagctactatctagggcgtctgctaggtttttccattaccctttgtatatctcttatgtgggaccttttgtttatggaagaatatggagtacttttattcatctcgtagggtcttgaatacaagattttatatatatcactctttaaaaatgaccatcctaaaattcttcctctttcatttgcatttaccagaattgatattagtacctaaactagtactcttcactgaggccttttgtatttagtcctattatatttgaatttggcactatttaaattaaaaaaataatctacaataaaaaattcttccctaaacattacccatcaaatactcaccacctaaggtaactctaccatgtattaattttttggatcaaatctagtgaggattaattctccacttatgttctttcggaactggctaagtaatcttcaaaagctagggcatctccgcagtcatatcgtgccctcccaagtatagcgaccgcttctatattttccctgaatttcatctgtgctagggcttgttttcacgttgatttcaaacaaaggctaacaatttcattgagtaactttttctcatttcaggactcgaaccttaaacctctgttcaaataacttctaagaagtatatatgtatacaatgtttgtattcattgtgacaaagtattatgagttgtacaactttcttgtgaagatagagcataatgttaaacaaggatctatatagagcataatgtcaacaaaacaacaacatcaacccagtaatcatcctactaataggatttggggagggtagagtgtacgtaaaccttacccatacaggggagggggtaaagaggttattttcgggagaccctcggctcagagacaaaaaaatctataataacaacagaaaccagacaaataatatcagcatcataagagacaacaaataagtggaatgacaataattatgccaataataacattgaaaaaaataaaattaaaaattaaaaataaaaatagtgtgatgaacaaaaatcgctagcagtcttagacaaaacactatcagactagctggaacaacgaggaaaaacgctgaagtaccccctaacctacaaccctaatgctcgacatccacacctccctatccagggtcatgtcctcggaaatctcaaatcgcgtcatgtcctgcctgatcacctcgccccattacttcttaggtcgccctctacctcttctcatacctgtcaaagccaaccgtcacacctcctaactggggcatctaggcttctcggggccggccagcccgtagatctaaaaggatccatccatagcgcccgaaccatccacgcctcgctttccgcatcttgtcgtccatgggagccacgcccaccttatccagccttatccagcctagtgtgcccccacatcatctcaacatcctcatttcgactactttcatcttctggatacaagaattcttgactggccaacattcagctccatacaacatggtcgatctaaccaccactctataaaacttgcctttaaatttcagtggcatgttagtatgtttactttagatacaatgttttttagagtcttatagtcttgttagaatactatatattataaaatatggagacttctgggcacttttgttttattttatataagataggattggaatgaattcaattggagggacatgcatgataaatgaatattcatgtagccgatatatgtttgggactgaaacgacattattattgtgaaatattttacaattgcatttcacactcactgaagtgaaactttgattccacgtcggtcaatacttaggtgttacggtttggctgcgaggggaatcgaagagagcaaattaattaaagtatttaatgaggaatcatgagttagttggtggaattataatagtcaaatgaatgagttattcgcctgataatatagttgatagtagtatatactatatatgttgatactagttattggtggtgacctaattaagtaaagagaagagaagagtggttatgtaaaggaatctaggtatagtgggggatggggggaggcaaggttaaaagaaaggtggaaaatccaagaatcctgcttcctctagtaacatagcatatcctgcaattcgtgcttttgtttcctctcacaagataactacttttttgattaattattacatttgacacatacatacaaacctataaaattagacatccttatggaatcttacgactccgaacttgtcatatatcctttaattatgcttagctttttgctaaaaacaaaaaggatatccttattccaaaatgcaactaggagcatcttcccacatttcttttttatgcctctgcatcatcaaatcccataatgccgcacaacaatttctttttacttaagtatattctagcttagctatttcatacgaataatgggtatacaaatttgcttattttaggttttaaataccgatttaaatatattggatgggttcaacttttaaaattcttacactgatatacatgcatagaatatgtggaaaactttaatattaattacaactgctaaacatttgaatggattcttcatgccgtgtgctcctttgttgaagaacacgtactccctccgttcgcatttatttggcacgttttgacttttcacgccccttaagaaataataaataaaatgcataatttatcatgataaacatatcaatttatgcatattttattagatttgagaaaataatttgaaatgagtaataaatactgtgagtataacaggaaatttttttttgtcttctcttgatatgcataaaatagcaagtaaaaataaaaatctatttttaatataaatgtcaagtaaaagtgaatggaggaagtatttggaagggcgatatcgaataaaaaagttatactaataacaaacagcaacaattacaagaaactgtagagttggccagtaccaggtatatatgtagaattttttttatgaggaatttagtgaaacgctagctatttcaacacttcagacatatcaataccaattttatggtttctcttaggtgttgatagattctcttttgtcagcaaacattatttatgaaatttataataaaatgctgctcttttcgagtttacattctccgtcccaatacaatatatacttgatttgacgaaagaaatgtaacaatagaatcttaagtcggaaaaagtcaaatcaaatttgaaaaaaat

SEQ ID NO: 151 - DNA, 5000 bp, Artificial Sequence
  Description of Artificial Sequence: Synthetic polynucleotide
gaaaactaaaaaaagaactaaggcatttacactaggtcttcaccggggctcgtcccatcaccagaacccgttggcctcaggtctcttggcttctttaatcttggccgacaggtcaaaacctcgggaatggatatcctcgagggtctctctctggtatagccgctttacgtactcggtcttcatctttaagcgggcctcagctatctccacatcagccttatactgggccagcatttcctcgacgtcggaggaatcaatagaagttgcctccaacttggatctcagcgcgttatattcttggtcgagggcatcccattccgtgacggctgagttcagctgtgctcggagttcatcatttagccgagatcacttgtcggccttgtcctttgccacccggagttggtcctttatcgatgtcaactcctcttttgcagcctctttttccgaagccagtaggtccatcctgcccttctacgcctcggtcgtggccttgacctcatccatctcagcccgaagccggtcgatcaggtctaccttctcttggacctgggaagttgcgttgttagtcaccacgagtagcttctcatttttagcctcaaagatccttaccttctcgaccaagtcagcgtgctcccacttcatggacaaggcctccttctgagccttttccagctcggctcagagaattgggaggtacttgagggcctcgtcttattgttcgctgagagacctgtaaatgtccttctcccggatcagttctttaagctcgaactcaagctgactgatttgcaagagagaccgaaggaagctttcatgatgaagcattcaaatctgaaatataataaggtcattagaatatgcggagcaaatattcgcaaaggatacaaaggatagacgtcttacccggttcaatgcctattgcacctcgttgaagaggctctacgtgcctacttcattcatctttgcctaatccttatcggtcaccaggcaacgaaggtagctggctatgccgaccggagcggacagggctcgggcgtccatcgggatagtaagaatgaccattctcttacggtcggggtcaacacccggggggagggaacttcttcactagtttcgggctcaagctcgagctcggcttgctcgctcccgatgacacatccttttttgggacctccaggtgaccaagcctggagaagtcctccaatgcgaccatgtccatgccatcaaagaacgtgttgagggcattatctggacccgacgctatctcatttaatttctctttattagcttgaacctcttcgagcatggactcagtataggacggcgtctctgcgatgtcaatgatactagctacatccttcgggacaggagcggcttctcgataggccatggactccgtctctccctctggttctcgagctagagggggatcgacctcttggtcacctttcctggttgccaccttctccctctcgttgagggtcgactcatgagcaatgaactcaaggtcgtcatcctcaggataatccctaagccggtagagggaatcagatttcggtaccctcgacttggtgctctttttgtttttctggacctggacgaccaccctcttcttcttcacctcgacatccggggagcctgtggatttccttttattcttctttttctcttcccttacggcggcctcgggctgtcccgaagcggagggttcagcgagcgaggacggatcctcgtcctcatccaatggcttgagctcggtggtcatgggtgaacctgtgagaagaaagaagacttagcgatatattcatcaagtatatgaatgtaatcattcgggagagagactcactatgggaacgagcctcccatttgcccttcgagagcttgcgccatacgctcgaagtaggacatctatttgcacatcccctcgattcactccttgaagcaggggaatgtattaggaacctgggcaactgctacataatggcaaatacaggcaattagaaaaaagaataaaaggaaatgccagatactcgagagggaaaagacttacgggatgcgtttcactttttgaggaatggtagaaattcggagaggatgaggtcttcggttttcacccgaacgaacctcccctaccaacctcgatctcggtcctcgtcgatgctcgagaacggagccttgcttgctcggcgaacgatcttaatcaacccctctcggaagattcgaggactgtatagatgaagtagatgttcgagggtgaactgaggtgcttcagttttgtttacaaagtgttggaggaggattacgatcctccaaaaggacaggtgaaggcagaccttgcaccttttatagatgtcgaggactatggggtccaccgggacgagcgtgaaggagtaagtgtaaacacttaggtacccctccacgtgagtggtgatgtctttgttgggcccggggacgaccacctcctttccctcccagttacactctacccgaactatgggtagtgtctcctcagtaacagagcatatgtacctccatgctccctcgtctcggtcctgttgactggaggctttctcgacgttgaagtcattctcgatagagcagcccccgagtacgaagctcttcaagggaggctcatgggctacctcaggaatggccacctcggcatttatggccagattggaaaataaaggagcggtttgttgaggaacgaatttgaaagtttttgctatcgggttctgaaaaatatgaaggtttgaagaaaaaatatgaagatttgaagatagaatggaaatatgaaggtctgggttgaagattgaaagagaatgtatgaagattgaggatgaaggtatgaaaatctaaggagcaatctatgaagatttgaaggagttaaaggtatgtaaagaattcaagggtaaatcaaggagctctagaatcgaaaagtggagaagtgaaaaaggggtcggagcttttatagaggaaggacaatcaatgcatgacgtttcacattcgaggacagtcaatcaacggccgatacgtgtccgatgttagaacgatgcgactaatgggacgtttcattgatccgtcatctcggttgtaacgtacgaagaaaggaatcggggttcatttatcgcttcccgtcgtttcgataaatctatcctccgaaaaacaaggggactatctgtatacgggtaaaatcaggcaatgtctaccctgattctcctataagagaataaagggggagcgcggatccgcgagattgtaatcgaggacagagacccatcgtatcaagatccaagaagagtgaacgatatatctaacatcagacacggcaaagcgatgtaccccggaccgaatataactcctagacctcgggagaagcgggggacggttatgcatgacagataggagactgtatactcgccctcaatcggatattacgacgcgaatctcgtcagtaacaattatggatcaataattactggaaaaagaagatttttaccttttttagacttatactaggactgaaattctcgtactatataaaggtaaagtttttctttgatctgacacattgtaacacgcaattcaaagaaataaaaatttgtttttgccttctaactaatgttaaaaattttgctcacttgttctgttcttcattcacgactggactcgaaccgagggtccaatcgagtacgaggtcactgttcaatctaagatcatgcttggtcataacattgcgattggtttgatcatttatttcgtctttaattcatttatctgttatttttaattattcgtgttgaattaaatcacgtatcatttaaaccgcgtacaaatttaattgttacccatttttaaggtaaacaactatagacgaaaaaaaaaatataaatattaaatattatgtttcgaaagatacacaatagacaagaaaagaaaagaaaaatcccttataaaatttggatttagcccaccagttttattgagacgtctttgtgtgttagttacccggcaaaggttatgaacctactttatgcgtcaatgtccgaatttatttttatcaacatccttttggaagagcttttgatagaaatggttggcttaattagcaatcatattatcatcacctgcgctttggtgttatatcattcggaatcatatcattaccttttgaaatttaaaatggttttcaaagacgtttcgataaaaaaattcctattgtcgcagttggaatctacaagacgaagatgttgatctagtgctatatttggagaaagtgccttaattaaaaataaaaaattgttgatcagttgtcttaagattttttattattaaaaaaaaaaaattaagatacaaagaaacacatttacgagtatatgtcggccgactaattaatgtgaagttccacacggtcaacccacacatattgtggtcaagatagattctatcataatcaaaagtcattatcgactcaattttcatatttggcatcttaagtacatgcacaaaagctacttaggatgtaagtttataatcattcattcttgaaatagaacctatttaatagtacttaattagttacagtagtataatttattctctgctaaagagctattgttcatcaaatatatcagattatcctttgtggtgtagaccatttccttatttgtacttagtattaattctggcaaaagcacaaaactgggaaatgaggttcttcttcattaatgttgagtcaagattagtactactactatagccaagaaaatgtgaaatcatatagtactaactttcccttctccctagctactgataactctaattaatttcagatgccaaaaccataaatttcccctcctccatcattgaaaacccctttgtcctttccccccagacccccttttcctctctctctctctcctttctctttttattagacgcatattctctcttctttctctttctagggttttcacctgaaatagttttatttcgttgat

SEQ ID NO: 152 - DNA, 5000 bp, Artificial Sequence
  Description of Artificial Sequence: Synthetic polynucleotide
attataagggaaattaaaaccctaaaaacaagattttatctatctgcatggtgaaggacaaagaggtcttcaatctcaggttctttttgtttttttaacttgtttggatatgaggttattgagctgatgaatgttttaattttaacataggcctacttacgtagtagttataggttgataatgatatatatttaactaagtctttgtataatgcagatcctgaacttaatttttatttttattattttgttgttaatgaaagattctgttaccaaattttatcagtctatttaattagaggccaaagattgttaggtatgtggcacttggagtgggaaatgatatattcccattaaaggtgttaattaaccaccaaattgttctttaggtctgtttgtcattttgtattaaggtggatggttcattatcttctctttaatgctaatcatgcttcaccttttcatttagtactagcaagcatatttgtttactttattggttattccttatcaaagtctttatcttgttgcttttttttttattgtactttacaaaagatttctggtattaatggaaagtgctcatatttggaaaaagacatggccaacaagaaaggtgtataccccatttctttttctttttctccaaattttttttttttttttttctgtttcttgttgagttctttcatggaagaagaagaagagtaggagattcttggacatggctgcatgagaattgttattgttttgtgcacttaaataaccccgtatacatacacaagtagtgttggctgtctttgatattgcaccatttattgccctaatttctgccttttgtcccctcaacaaaaccatcaaagttctcaaatagggtttattcttgtttcccactttgccccccacccattagggccaccccaccaaagggatctctctcgtgtctagtgttttttcccaaggaccaccactacttttttttttttctctaccataacttccacaccatcttgtgatctttcgtttaataatgattttgcagccatgccttcgttcatcagaactcggtcataagcacagattctgagagagtaattaatgaatgaatcagtggtgatttgacttatacatgattatggtttttagctcaataagcagagggagaaaatatatataaacaagtaaatctagtagaagaagtagaagttttatagctagagtagtgggaaagaatgacgcaagattagtaccaaaagagtgaaggaagagctttaatatagggaaaagggaagtagtaggtgatacttgacaggttgataagatggttactactacaagttgatgtattgacgctaactcacgcaagagacctactcactgtgcaatatttacaagaagcgattctttctctctttacttgcaagagttgtgtgttccgagttgtatggcgcatatgaaccttttttcatacaatacaatacatatggaatagatagataagacggtgcacgcatgaggcaattatgcaacttaacatcaactacttccatcatcttttcttccctctgtttctgtttctgtttctgtttctgtctgatatactatatgcttctctggcctggattttcctaactcttttgataatttaggttcccatcaataatgtctttttagaggagcatcatatcgatagatattcaaatattaaacctggcctagggctagggcgtctgctaggtttttgcattactctttgtatatctcatctgtgggaccttttgtttatggaagaatatacttttattcatcttgttgggtcttaaattcaagatttaatattactctttaaaaattaatgactatcctaaaattcttcctcttttatttgcatttacaagaattgatattagtacctaaaactcttctctggggccttttgtatttagtccttttatgtttgaaattgacactatttaaataaaacataatctacaataagatgttcttcacccttcgggttgcccggttggtttggatgggatcgattcccccgatatcttctgggttgagcatatcgcacagggcttgtctagtgcggtttgcattccctatgtggtttgcattccctatgtggtttgcatgctattatacatgggtttacccagtggacacaaagtattcaatacagagtgttcacccgaagaacagaggctgtggcaaagattgtaacggccgcgggtttcccctcttacaaaaaaaaaaatgttcttccttaaacattacccatcaaagactcaccaaagatagctctaccaagtattatttttggatcaaatggcatttccacggtcatatctcctcccccccccctcacccccccccccaaagctagtgatcacttccatattttttcctgatttcatcggtgctcaaatacttgttcattcatcttcattccaaacaaaggcgaaaaacttcactattgagtgcttttttcctattccaagtgtcaaaccctaaacttctagtcaaataatatctaagatgtatactcttatactatgtttgtattcattatgacaaagtatgatgagttgtacaattttcttgcggacttagtgaaaatagagcataatgttaaaaaaatatttacatgatattaattagccggattaagtttataacgttagtatatatgtctactttaggtacaatacaagtcttatactcttgtcagaatttatatgtcacaaaatatagaaacttctagctacttttttttaattttatataatataatattggaatgaatttaagtggagcaaaagtgaatattcatgtagtcgatatattctaatctgtttggggctgagatgacatgattgtagtgaaatattgtaccattgcatttcacactcactgaactgaaactttggttccacgtcggtgatcatttgcatgtttcattagtcaatactgtggctgttatgatttggctgcgagggggatcgaagagagcacattaaagtatttaatcaggatttatgagttgaatgctgttagttggcggaattaatagtcaaataatgaatgagttactcgctgatatagttaatagtactccgtatatatgttgattctagttattggtggtgacctaagtaaagagaatagatgagaggagtggtggtatgtaaaggaatctaggtaaaggggtgggggtggggggaggcaaagttgaaaagaaaggtggaaaatccaagaatcctgcttcctctagtaacatagcatatcctgctattcgtgcttttgtttcctctcacaagataactactttttgattaattattacatttgacgcatacaaacctataaaattaaactaatcaacgacatccttatggaatcttacgagtccgaacttgtcatatatataactttaaagtactttgtcacttcttaatatgctcctttaattgtgcttagctttttgctaaaaaacaaaaaggatatccttattccaaaatgcaactgggagcatcttctcacttttcttttttatgcctctgcatcatcaaatcccacaatgccgcacaacaaactcttgttacttaagtatatattctacttcataagaataatgggtataaaaatttgcttattttatgttttaaataccaccgaaaattcataagcaaattcaggatttaaatatattaaatgaattcaacttttaaaattgttgcacttatatatatatatatatatatatatgcatatccaagttgagggatacgggttcacatgaactcatattactttctctaaaccatgtataacaatgttatattttttcaaaattatttaaatatatgtgtgtgaacccattctcaaaatctcttatggtgcaattattattgggtgcacatctacaagtgaaatttgcagctcaaaacctcatctgggcggtcttgttttccgcatggagtataactatatatgtgaaaattactagaatttcaaaatgaatataattttgaaatgttgtgggttcctggtaagagactaaagttaaactcgtcaaatataaattctagatccacctcttcacaatagtgcacccattcttttgaaattctggatctgcctctgttaataatatatatatatatatatatatatatatatatatatatatatatatatatatataaacacaaaaaaatatgtggaaaactttactattaattaccactgctaaacatttgaatggattcttcatgccgtgtgctcctttgttgaagaacacgtacttgggagggcgagatttcgaataaaaaagttatactaataacaaacagcaacaattataagaaaatgaaaataaaagggaaagagcactcacataaactagaaactgtagagttggcaagtaccaggtatatatgtccttgaatgttttttacgaggaattgagtaaaacgctagctatttcaacacatatataaaaagcatcaataccaattttatggtttctcttaggtgttgatagattctcttttgtcagcaaagttcttgcattaactatatgaaatttataataaaaatgctgctcttttaattgagtatacatgcagtctcctaacatatacattctccgtcccgatatatacttgatttgatgcatttcaaaaattaaatgtttgagtgttttggtgaattgtgcttgatatagaagtatttaaaataagaaagaaatgtaacggcagaatcttaagtcgaaagtcaaattaaatttgaaaaataaaaaataatactcttgatacttactagtactagtcaatgggcagctctttcgggactaaccaaaagcattattcttattgtttccggcatagtattaaaatgtaacaatgcttaattatgttacaaaattaatgtttttgtggacttcggaataatttatttctgaattcgccggtgttatcgaaaacatgggga

SEQ ID NO: 153 - DNA, 5007 bp, Artificial Sequence
  Description of Artificial Sequence: Synthetic polynucleotide
tgggggccctccgcacaagggaggagctaggggaggcaagaaaattacatgtgtatataagattaaattttcttcttcttttttgtgtataggataaatatttaattttcttaatttttttgcgtagttactcttttaattatttttaactcctctgaacgcaagtcttacctccgccgctgactcctctagagaggaggggtctaaatgcatgcaactcaaacgacgaaagggtctttgcctaactaaaggttccttattctaatatatccttctagaaaaggtaatagaagttgattcgaatatcaaagagagatacatgtcggttacaaaaataattctcaagataatcaatagacatctctagattctcggacttaaaagatccatttagacacataatcatattttttttccaaacaatcgtcgaaggcagcttgttgcacaaaatatttcgtatttacataaggtttaaggaaaaatcgtacttcaaagagtatgatgtagataatacattctaattagggtcggctctataggtgtaaggcaagtgtcttaggccccaattttgggaggccccattttttagtaatactatatattttagaggtttataatttttttttaaataattaaataatatatatagtatttttttacttttcatatataaaaaagaaaaacttttaatatattaataaagtaaagattaaaatagtactaaaaaatagttgtcactttgatttgatttgacaactttactttttgctcttcttcccaaataattcctagacccaatccaacatttcaattttcatatagaaggatgagacatagtaacataccttcttcctttcttttgattcgtgctcattttgtttctactagatttctttctttctccaaaactccaacaagccaacaactacatattttgaaatcaaagtcttcaaattttttgaatcagttagtcgggtaatatcattctaactttttagtattatttttatttattatttattattttattaattttaccatgtacatattgtttaatttttttagaatataaatatgtctacaagaaaatatgcatccggatattcaaaaatccaaaagaaaagaaaagttgaaaatttaataaaatctcaaaaaggagttctcgagaatttttgacaaataataaaaaaactaaatcgcaaaatgtaggagaatattctgtagatgaacaagtcactaactttgagtcagatgataacaaaattcaaattgaagaagatgtttatgagaaatctgacgaagaaacaaactttagccttaggccctatattaaactttggccctaggcctcatatgagcttgagtcgcccctaattctaatacaagtattagtggctactttcacggcttgtgacttatggattacaaacaactttacagttacgtcaaggctccacgtagttctcaatttatggagcatatattagatgattaacgcagggaaagattctgctctcctctgatacatggctattattcctcgtttagttcaaaaaggaaaaagagggtagtcttgttatattattggggaatgaattatggtttcaaacttttcaaacttaaaggattttgtacatggtaaaacctaaattgacacgtaacttggtactttcaaagacacgatcttttacgcgatattttaaataaagaaaagatcaagtcaaaacatgggccaaaaagaaaaaccccatgattttttctgataaaaagctgctaacttttagtttgttttatccaataaaacatctttaacggtctgcctgctttagtttaatcctctttttaagatgtaattaagcataaaatagaaaagggaaaaaaaaggtccattggattttggaagaaattttaagaaagtacaagaactagtaaagtcattttgtatagagtatgttaaaaaggtgagtgacaattcgaaaaagaaagcattgataagtcaatcactaaataaaaaagcacacctaataatcattcattcaaaaaaacaaatttctatgaaagataatcattatcataagtcactgcagaaatcccatatacagtagagtaccaggattttacgataaggtgttagcaaactatctattcattttttgacaagcattttatgtttggtcatttgttgggaaaaattagggagaaatttaaaaatagttagatttacaactggtcattaaaaatagcccaatttcaaaagtaatcgaaatttagccacttttcatgtaaagataaatctgagcgaaaatattgttcaaaacccggaaaatacgcccgtatattatactggagttccagcataagtatgcttgaactccagcatattatacgggagttctaggataactatgttggaactccagcataatatgttggagttccagcataagtacactagaactccagcatattatacgggagttccaacaagtataactgtcccgtataatatattggagtttggagcaccggtgctccagtctcccgtatattatacaggagtcagcaaagtataccggtccagcataatatgctggagttcgtacacagatgcaccgaactcacgtatattatgcggaaccggtctctgttgcagcaaaatagtggctatttttcattgacttcgtaaacggtggctatttttgaatgaccagtccgaaaactggctataccgtgctattttgacgaaaaattatccccccacccacccacccacccaaacgcaccttacacacattagtgcacatcttttaactagtttttggttatttttttatttgatgcccgatattcgtatatggatttcgattaattagaattcacaccgaaacattctttcttaggattttgtacatacttaatatgcgaatacaaaacctatgcggaaaggtaagggaacctattcatccctctacagtacttgtgataatgttatacttttttgaatttaatttgggagacatgtcaatctttattttgaaaaaaaaatagaataaaaccatagggaaatgaacaatttatctttcactcctatctcattttatttgtcttgaatttttcaaaattttgaattatattttgaaacttcttcaatttattttcttggaatcttcagaattcaatttaaaattccaaaattccaaggatttagctcccgtttggccacagattttggcttcatttttttaaaaaaaattttgaaaacattctttgtttatgcaatatgatcatgttttaggggaaaaaaattaaaaaaaataaaaaaaaatcaaattcccaaaaactggttaggcaatttttggatgatattttttcttccactcacaaaactttaacatgtccaaacacaacttcaacttcaaaaattattttcaacacaattttaaaaactcttttttcaagtttcaatcaaatctatatccaaatgttagcttagtatcaaataagtgattgaaatcaaattaaaatcgagtggtaaataaaatagaggagagctcggtaaattacaagagtgcggtaaatcttttctcctttactctcactgtagcctattctatctgttgtaactaataagtaactgagctacggaaaaagtgcctagacttttaacttcacaagtataataaatagaagtcaattctttcataatattgtttccatcctatcaaacagactttgtctcactgaccttccttctgagtgtgtcttttatatgtcatttttagtgaatccatatgatttagagactctaatattccacatgcgggtcttaatttggtgtatatgtatatggtaataatttttgttaggtagctgtagtattctattattgttatgtattgactcatcatgtaaataaagccggttagataaggctagaaaaatatgagtatacctagaaattattagcatattgtttggaacatgtcaaaaatttcaatgacctagctagagctgtcaattagtcaaataactttattaatatttacttatgaaaacactttgaaattcttggagtttaagggaaagactactgactaaaaaacaaagcaaaagtctatgcattactatactatacacagcacagcattttccaatagtatttgagatgaatctccaatcagctactgttgttcttttcttttctttatttagtttaagttttatgtgttgatggtatacaaattatttgcacaatcaaatggcttatctggataatataggtaaacctcttgtaatcactaattggtaatctggtaaaaataacactatttctattccaatttatgtgatcaatttcactagacaaaaatttaagaaagaaataaattttttagaacttgtagtcataaacaagttgtaacatttgtatggctataatttttttaacttgtgatgttaaacatgtcagattgtttgtgtagctataaaagtttttcattaggcgtaaaattaaaaatttagattaaattattattaaatttagaaagaggtcattttttttagcgaagtaaaaaagaaatcggttcacataaaccgaaacatagagtaagtaatctgttatgacaaattaaaaattacttgtagtgtaaaaaaatctttacaacattcgtgtatatacttaaatcttttttattttttggcaagagatagttgttcagcaaaagtaagttagaaataggtctgtccttctgactttgtaactctgaaatgaaaatttcaaaatcccttctatttttcttttccccccccccccccctcacaaaccccaactcactcttatttaataaaaagctctacttagaaaagacacccttgtccatctgtctatataggtagaatgagagtaaaggagaaaacatatcctcctctccatttctgtagacaaagattctcaaagagaaacaaattaaacactagagagtgagagagtgctataagaaaaagaat

SEQ ID NO: 154 - DNA, 5000 bp, Artificial Sequence
  Description of Artificial Sequence: Synthetic polynucleotide
agaagaaatgactgttgaaaagaaaacaaatgcaagtaccattaggaagatttgaaagggcgtttgggtatgggggttgccaagaagattcagactttttttggggttttgtgtagttgtggtagaattattattgaatgaaaaaaaaaaacttcctgtactttaattcgtcagtacatactacatactactacaaagtagttaaaagcctattctatttgtgctttttttttcactcgatgttcaataattatattggtttttgattaaatttgaatttgagcaaggaagatcaacattggagggataaattgtttcctaacgaaggcgattacatacttagaacttgaactcaatatctctaattaaaaatgaagtaatacttataataactccaccacaattcttattgttgtgcatttctttataaaatatgtaaataatgggtcatatatattgtttaccttttctattcatatacatagattttaaattaattatacacatatatataatacattaattattcatatattatatttttgctagctatttttagtttaagcgatttggtaggcgactacttgggttaattctttttttttaatatatatatcaaaataatgaagctgtataatacacttaaaaatcatatttgaaaggtattaaatacgacttaggagagttcttaaaccattttggaaccttgtctacgtacttttatgcaatagctgtttttgtttgtctctgctaaaacctatgctccccaaccgtgcaccaatcaacttagaagttagaactcagaaataaatgtaactatactccacagaaagttaaaaagttttactgttaccattcactcaaggatcagaaactgaaagacaaatgaatcagtgcttcactgttcttcactaaaagaaatactgtttacattagtttcaaaagagtttaatcataaaaacaaatgtaccataaaaaggggagattatcaacctgaaaatgaaacagaacatacgttatatatcaatctatatacggtcgagatcggactcgtctattacacgacagatcgggattgaaacgtaacagttttgaagatcaaccccgggttccgtcggaccgaggtacaaggtcagaatgcccgttctcgagaacatcgagtccatgaccccagaatcaaccctgaccccaaatgagctcgaggaaacatccggataacggaaggcgaaatatccgtaaccggtcgggtatcacggcatgaatttcggcacgtaacaatgagaaaccggctaattagcaaatcatggaattttttaccttttatagaattgtaactaaagtgggattcccctactatgtaaagggggtctgactatttgtacgggacattcattaaacgcatcccaaagtaatataatattattttctttttgtaagctattgttctcctgtatctgatactatttgaattgcatcaagttcaagtgagactcattttttcaaggctataattgttcaagtcgcacggtttgaatttattcgatcattgttcgctttaattacaattcaattcatcgctttatgtcaaattaatccacatatccttaaaaccacttacaaatttaattgttatcaaattttaagggtaaacagtttggcgctcaccgtggagctaaggataatagtggttgtttgatatagattttcataacacacactattttacaattgttcttcgaagtgtctctcatttcaggtttaagctcaaaatgtcaaactcacaattggcacccctacctgcacacaatgagtctggtcaccatggtgaaaataacaacatagcacctggtaacgaggtaccgcccgctgatcccatcagaatttcaatcgcggacccgttggacgctaactcgcatgtggctatcgacatgttacagtctcaacaggcgacgatagctcagttacaaaaccaaagccgcacaccgagcagagttgaactcgatccgtcccggaaaatcacctgcagggaagaaccgtccgcggagaggtcaaatggagatgagtcggggactaaccccgagatcataaaaatgcttgaggaaccgatgatacggattgaatcaggggaaaagaaaatcgaggcaaatgacaagaaggtaaaaacttacaatttcacggtcaaccaaatcccgggagcaccgccggtactgaaaagcttggattccaagaagttcgtgcaaaaacatttccctccgagtgtggccccgaaatcgatcccaaaaacatttatatgcccgagattcttaagtataatgggacaaccgacccaaacgagtatgtcacttcttacacatgccctatcaaagggaacaacttagaggttgatgagatcgagtctgttttgttgaagaaattcggagagaccctgtcaaatggagctatgatatggtatcacttacctcctaattctattgactcatttgcaatgcttgcaaactctttcgtgaaagcacacgccagggctatcaaggtcgagacccagaagtcggacctcttcaaagtaagacagaaggataatgagatgctcaaagagtccgtgtcctagtttcaaatgaaacagaaggacctaccaccggtcgctgatgattgggccgttcaagctttcacccaaggactcaatgttcgaagctcggtggcttcacagcagttgaagcaaaatctgataaagtacccaactgttatttgggccaatgtgcataaccgctatcaatcaaaaatcaaagtcgaagatgatcaacttgaggctctttccgggtcggtttaccctgtcagactcgtcgacagaatcaagagagatatcgaccgtgaaccaaggtcaaacgtagatcattactagccatatgatggagattggaaaagcaataggtctgggtgaagttctacacagaatgaaaagagaaatgatccaggtcagagcactcgaggactcgcaagcaagaacgacttcgacaggcctatcaggcctaaagaagcaccaaggttatcgaaatataactttaatattgatgcggctgccatcgtatcagctatcagacgcatcaaagataccaaatggcctcgacctttacaatccgatccagcccaaagggatcctaaccaaatgtgcaaatatcatggcacttctggccacagaataaaggattgtcgacggttaagagaggaagtagcccggttgttcaataacgggcaccttcaagaatttctgagcgaccgagccaagaatcattttagaaatagggattctaacaaatagaccgaaccagaagaacctcaacacgtcattaacatgatcatcggtggagtcgatgcccctcaagtgctgatgttgaagcgcaccaaagtgtccattacaagggaaaaacggactcgagattacatattagaaggaaccttgtctttcaacgacgaggatgcagaagggatcgtgcagcctcacaatgatgcattggtaatatctgtactcataaataaatctcgagttaagcgtgtgttaattgatccaggtagctcaaccaacatcatccgattgagggtcctagaatggcttggcctacaagatcaaatcatgcctgcagtccgagttctaaatggattcaacatagcatgcaaaaccactaagggagaaataacattgccggtgaataccaccagaaccatccaggaaaccaagttttatgtgatcgaaggagacatgaggtacaacgctctgttcgggaggctaaggatctacagcatgagggcagcaccctcgactcttcaccaagtgttaaagttcccaacgtcgggagggatcaaaacaatctacggggagcaaccggccgcaaaagaaatatttgcagtcgaagaagagatcccggtatagacactagcaacatcaaaggaaccgagttcggataagaaataataggctaaatagcaattatcgacaccagccacgacccaatcggataaaaaggggactgatgaagatgatgattatggggttcccagatcttttatagtccctgatgattctgacgccaccaaatcaatggtcgaggagctggaacaggtcacattaatcgaacgtctacccaatcagaaggtatacctgggcacgaggttaacccccgagcttaggaaaaactcattcaatttcttatagctaacatagactattttgcttggtcccatattgatatgacagggatcccaccggagataatcattcaaaagctgagcctggacttgaaattctacccagtcaagcagaaaaggagaccccagtcaaaaatcaaacatgctttcatcaaggacgagtatttgcacaaaactttcaacatattgaagaagtacaatatgaagctaaacccggagaaatgtgcattcagagtcggatcaggtaaattcctcggattcatggtatccaatcggggaattgagatcaaccccgacaagatcaaatccatcaaagatatcacgatcgtggacaacgtgaaggccgtgcaaagattaatcggccgcatagccgccttggggcaatttatctcgagattctcagataaaagtcaccggttcatttcgctactaaagaagaagcacaacttttcgtggaccccggagtgtcaccgggacttggaggaactcaagcggagatagctgcttcacacaacaaaggcaaacgaacaactatacctatacttggcagtatcggagatagcggtaagtggagtcttggtccgggaagaacaaggtacacaatttccaatttactatgttagcaggaccctaggtgaggccgaaactaggtaccctcacctagaaatattggcattcactttgctaagcgcgtctaggaaactgaaaccatatttctagtgacatcccatatgtgttgtgattaccaaccaattgtggaatataatgtataaacggctactctcgggatgattggccaaatg

SEQ ID NO: 155 - DNA, 5002 bp, Artificial Sequence
  Description of Artificial Sequence: Synthetic polynucleotide
aatgcagcctcagtcttcaacataaaaaatcacatgagtatataagattaatttttttttttttgtatatatgttagatgttgaatttcttagttgttttgcgtgtgttttttttttttttttttgacctccctcggtaaaagtcttacctccggcaactgtctccgcgagagagagggggtctaaacgcatgtaattattcaatgattgaaggatggtctttgcctaaatactaaaggttccttattgtataggtcataggtgttgattcgaatatcaaagagagattcctgtgggttataaaagtaattctaagataataaatactctttttagaggtgttgttttactgtaaaatacgtatttggttaaagtgatagacatatctagattctcagacataaaagatccatttagacacataatcatatttttgccagatagttgttgcagctgaaaattggagcatatatacttagaagtagcataacactttacttccatatagtcggatggaaaattggagtatcatatcttcttttaattcacagttaaatctttaaacatatttaataaattttttaatacaaatataaagtctatgcaaaagttattgggttggtccaagcccttaatttcgatctctagctccgtccccgcatataattctaaaacttctgcttctcctatgatacatggctaatgtttatcgtttagttcaacaagaaaaagagggtagtcttattatattatgaacggcaaaggtccaaatatgcccttgtactatacgaaattgagtacatttgccatttgttaatactttagctcaaatatacccttaccgtcacgtagttggtccatatacactactagaaatccggtaaaaccgaccaaaaaaaccgaccaactttggtcggtaatggccaataaccgtccaaaacacgaccattacgtgtggacggtattttaggggtcggaaaggcataccgaccaaagttggtgtaaattaccgaccaattttggtcggtcaattaaattaaaaaaaaaccgaccaaagttgatcggtattttaattatgtaatcaaaagattgaccatctgggaatcgaaccggggtttgtattgtggcaggatactattctaccactaggccattagtgcattttgttttaagactgttttttatttgatttatactctttaattgtattttcgcacgaaaataaccgatcaaagttagtcgattttattaaaaaataaaattaccgaccaaagttggtcggttttttaaaatgaccggccgaattaaccgaccaattttggtcggttttttaatattaatttttatttattttaattaaaactgaccaaaattggtcggtttcttgaaaaaaatttccgggactcgaaaatagtttttcgcatttttctccaaagaaaaccgaccaaagttggtcgatttcgtaaaaaaaaattaaaaataaaatattttaaaaaaccgaccaacttttgtcggttttttggtcggtgttttgaccgaccaaagttggtcggtcgaccttggtcggtttttgccgaatttctagtagtgatatacccttagagttacacaattggcacatatatgcccttctcaaaacgaaattcacccaaaaattatggtttaaactttaaaataataaaaacatctcaaactttaacaatactcaaaagaccaaaatatttaaattatttctaaaaagataatttaatgattaaaagcctagagttcaagttgtagtgttataaatttgagttgttagtctttttcatctttttcagctggacattttctattttttttattaactatgtaaattaggggtgtacatggaacgggttggatcgatttttatcaaaactaaaccaaaccgattatatcggtttgaattgttcggttttattggttttttcagattttttgttacataaatattatttcaatcttgctttgttaaattttttagaactaaatatatgttcagtaaaacttaaaaaattgacaaacatatgatctatcttgattaccttatgggagaattttcttagtaattggaattcatgagttttgtcaagtgaaattggtgacgaaaatagagaagacatcagtaattgaggaaatcggataagggagaaagaaaaagaaaaaaagaaaaaaagaagaaagaaaagagaaaggtaaagaaaaaagcactaataaaaaggaaatagtatttgtaatatactttaatacaattaacgtaagagctaattagtttgagtggattccgttttgaaaagggcatacatgtgccaattatataactctaagggcatatatggaccaactatctgacggtaagggcatatttgagttaatatattaacgaatgacaaatgtgctcaatttcgtataatacaaggacatattacattttccctattatgaaatggttcaaacttaaggattttgtacatggtaaaacctaaattgacatgtaacttggtactttccattgggcaaagacacgatcttttacgtgatattttaaatcaagtaaagatcaagtcgggccaaaaagaaaaaaacccatgattttttaagataaaaagctgctaacttttagtttgtttcatccaataaaacatctttaacgatctgtctgctttagtttaatcctctttttaagatgtaactaagcatgaaatagaaaaggggaaaaaaaaggaccattggattttggaagaagttttaagaaagtacaagaactagtaaagtcattttgtatagagtatgttaaaaaggtgagtgacaattcgaaaaagagagagcattgataagtcaatcaataaaataaaagcacacctgataatcattcattcagaaaacaaatttctatgaatgataatcattatcataagtcactgcagaaatcccatatacagtagagtaccaggattttacgataaggtgttagcagactatctattcattttttgacaaccattttacgtttggtcattttttgggaaacgaactctcccaacattcttccaaattaccccacgcaccttactgtgcacatcttttaaccaacttctggttattttttcttttgatgtccgatattcgtatatgaattcccattaattctaagttgcaccgaaatggtttttatcaagattttgtatatatttaatattcgaattcaaaactaatggtcgaaggtggaagatcgtatccatcccatcataatatttggttggtaatatcacacctttttgaatttgggagacttgtcaatttttattttgaaaaaagaaaaaaaaaagaaatagaaactaaaaccatagggaaatgaacaattttattttcactcctacctcattttatttgtcttgaatttttcaattttgttttgaaacttcttcagtttattttcttggaatcttcagaatttaatttgaaattccaaaattccaaggatttagtgtcaaatcagtgcttgaaattaaatttaaaacgagtggtaaataaaatagaggagaactcggtaaattacaggagtgcggtaaatcttttctccttttctctctttggagcctactctattctattgtaactaagtaacttaactacgaaaaacgtgcctagacttttaacttcacaagtataataaatagaagtcaaattctttcataatattgtttccatcctatcaaacagactttgcctcactgactctccttctgagtgtgtcttttttatgtcatttttagtgaatccaattgatttagagactcaaatattccacatgcgtgtcttaatttggtgtatatatggtaataatttttgttaggtagctgtagtattctattattgttatgtattaactcatgtaaataaaagccggttagataagactagaaaaaatagagtctacttagaaattattagcctattgtttggaacatgtcaaaaattcagtgactcagctagagctgtcaattagtcaaataactttattaatattaacttatgaaaacacttggggattcttgtagtttaagggaaagactactgactgaaaaacaaagcaaaagtctatgcattactatattatacacaatacagcattttccaatagtattttagataaatctccaatcagctactgttgttcttttcttttcttttttagtttaagttgtatgtgttgacggtatacaaattatttgcacaattagatggcttatctagataatacgtgtaaatctattgataatcattaattagtaatctggtaaaaataatattgcttttgttctaatataatgtgatatatttgactgggtacgaaatttaaaaaaaaataagacatatagaacttgttgtcttaaacaattcataacatttgtgtggctataattcttttgaaacttatggtgttaaacatgtctaattgtttgtgtatgtataaaagattctcattaagcgtaggaaaatttgaattaaattatttttttaatttaaaaagagatcactccttttagagctgacttaaaaagaaattgattcacataaactcgcacggagggaataagtaatatactatcaaaaattaaaaatcacttgtagtgtaaaaaaatctttacaccaatcgtgtatattctcaattttttttttttttttggcgagaggtagttgttcagcaaaagtaagttagaaataggtctgtacttttgactttgtaactctgaaatgaaaaattcaaaatctcttcttttttactgttttaaaaactccaactcactcttattaatataaagctctagttagcaaagacacccttgtccacttgtctatatagcaagaaagagagtaaaggagaaaacatattctcctctccatttctgtagacaagattctcaaaaagaaacaaattaaacactagagagtgagagagaactataagaaaaagaat

SEQ ID NO: 156 - DNA, 5000 bp, Artificial Sequence
  Description of Artificial Sequence: Synthetic polynucleotide
agaagaaatgactagctgttgaaaagagaaaacaaatgtaagtacaccattaggaagatttgaaagggcgtttgggtatgggggttggcaagaagattcaaactttttctggggttttgtgtaattgtggtggaattattattattgaaacttctttacttcaatttaaatcgtcggtacatattacgtagttgtagtaaaagccttttcctttttgtgcttttttttttttttcgtgttcgtattaagacttcattaaatccaaatttgcatagggacggtcaacattagaggaataaattgcttcctaacaaagacgattttatactcaagagttcgagcccgaaaaacgacctctggttaagggtaaaaatagtaattacaataactccaccacaatccttattggtgtgcatttcttcattaaatactccctccaatccactttaattgatttgtttttggctatttttatatatattaaggaattatcttttagcattaatcaataatgaaattgaccatattaaccttttagttcattggaaatataacaaatactcctaggctttttaattcaagagcaacttttaaatccgaatttgggctaagaatacaagcttgttcttttttatctgtttttcactcggtgtacgaggactcaattaaatccgaatttgagctaagaatacagacattagaggtaatatgctttctaacaaatgtgactcaatgttcagactcagaactcgatatctctggtaaggatgacatagtacttacaataactccatcataatctttataggtatgtatttctttataaaatatgtaaatagtgttatgattttttgtatcaaaaatgatgaagtataatactcttaaaaatcatactccatccgtttcaatttatgtgaacgtattttctttttagtctgtgccaaaaagaatgacctatttccttatttggaaataatttacctttatgcaatgatttatagtcacacaaaatatatgtgtctcatttttaaccacaagttcaaaagtcttctatctttttttaaactctgtgcccagtcaaatgagttcacataaattaaaacggagggaataataaaaatgtattaaagactacttaggagagttcttaaaaaaccattttggaaccttgtctacgtacttttatgcaataactgcttaagtttgtctctgctaaaacctatgctccccaaccgtgcaccaatcagcttagaaatttgaactcaggaataaatgtaactacactccacagaaacttaaaaagttttactgttaccattcactcaaggatcagaactgaaaaacaaaagaatcagtgcttcactaaaagaaatactgtttacattattttcaaaagagtttaatcattaaaatagatgtaccatcagattagctaaaagataaataatcgttaaaaaaaggagattatcaacttgaaaatgaaacaaattatatgttataatatgtcaaaatatactgacagtataaaaactcgttaaatgtgttaaatcctatgaaaaaactgcccaaataaatatttgagcttaggtgtcaaatgttgtactcaacaacaataacaacaacgcattaggatcctactagtggggtgtccaatgttgtactattgaacattattcaactaacttttgttaggtgttcctgtagtttagtgaaattaaagtccactgttcccctatatattaatcccaaattaattaatcaagtgcagataaaaatttctcattttctattaatttattaagtgtaacaaactaaagaaattcaagaatcttgaatgatgagaaagagtcatgcatgtagaaaaatagataataatacatggaaatatatatgtatttggggatttgcatggtagctcaaagattattggaaagtgacaggaagataaatcaaaatctcagtgttatttcaaaaataaaaggcacagattatttaaataattgacagccagttttataatactatgtgggaggggacagagatcaatccatgtacgtgcatggctaatattaaagtaagggagaaaaaaatattaagttaattgatgattaaaaatagtaaaatttcagacgtatatcacggcaatgaagagtttgatctttaatatctgtataatggtccataatatgatggataggcgttgtttatgatatgattgattgatcattgatcattgactattgtttcttgaataattaatcagtatgggaaagggtcccattaaagttgaccatttgcttagcaatattatcttaggtaagctccatattagtttaatccacttgcgaatatattccgtcctcgcaaatcaatatttacaattcttttttttcagttttctatccggtatctgatacttgcattggtgttcgacaaaatctgtattcgcgtcaaaaaatttcatattatggggcaaaatgctccataataaaagcgactcaatattagggctcgaaccaatggcggaaacaagatttttactaagggaattcaaaaaataaaaacgaaaacacatgaagaacctcagggaattcaacatctaatataaatatatgaaataaaaatttgattctattgtaatttgatatacagtgtaatttacaccgtaggggatttggctaaacctccttccgcgtacctagctccgtccctgactcgaatccgaggtatttggttaaaaatgaaagagtacttctcataacctcgtcggtttttgtttctaatcaatctttatattgttaaaacataaaacgtttacttcctttcttcttcttttaagttttgaaaatgataactacttttgtttgactaatattttgtagtttttgatgctaatcaattttgtaaaaattactgtacttcaactagcgtttactaccccacctcactttaaaaaattccctaaagagataactttttgattaattcataaactaaattgaagaacttttcaaatgagagtaagttgaaaatgcatattatattgtagtatataattgcaattttgcataacttaccgtaaaatgttcttccttttaatgatttgttaatatgggaaatttgaacttttctttctttgaaattgtattcttgtcccatggtttctatgcaatctcaatcatcaaattgcaattatttttttttgttttttgttggcaaattcaggagagcttaggtcagtgatatatgaaaaactattttttactcttatttattttaccctttacttattaaagaataaagtccaagacgaatagacgatgtacaacgcaaatgtaaaaatacaaaaaaatgtttacgacttcttctctatttattttctacttaatttacttattaaacaagtacttacttgttaaactagctaatctgaccaacaatgtgaaaatgtttgacattatacatcttgactttttatttctctattattttctcgatggttacttcaaatcatagatttgctaatctgaccaatatcgtttaacttcaagtagaacgaaatgaacatttcaaggttttagaaaacagttgaaattggaccctaaaataaataaaatgaagttattaataggtttacaccccaatcttatctaatgcttaaaacacatagtgtggagcggaattcattgtcttcacattattgtacattaatcatattttcttaactaattctgacgattatttgtgttcatctaatagaaaatgcaaaagtcattttccttaatacttggcatctttatagtcaaaatataactcatatccaatgcaaaagtacagtcatgcacaacaatttaaagtattaggagcatttattagtttcacttgtttattaatgtaaaagtacgtagtaaaatgaaaggtaaactcaaaaatatcacatacatattttaatttgatcgatcaagtcagcttgagttcttgaactttgtgaaagcaatatatataatatgaatgaaacacttatgcattgcgacattgagagttaatttaagaaaattttaccccacaagttctagctttgattgacaggcctagccacaaagtaagatatgcacaatttatcttagtgcttctatgttgtgtatcaaaactcaacaagttatgtttagtactcctatgatgtttatcctaatttaaaagtcaatattaagtaaataaaaataaaaataaattaaagtctatgtatgtattctcttaccaatgcctatagtttaggcccagaacctaccatctccctgccaacccactactcttactggttttgcagaaatagttgctgatcaaatcatttatccaaagatctagtttcaaccttaaagatggaaggttcgagtcacttgattttgaagtattgacttaatgatgtactttctttaacataaggtgaaattagttgtggacttcatcgataatctgtcgttaaatcgtttgtagctaactaaaaatctatcgcgaaataggattaacgacgaatttttctgtttaactagagaattttttcgtcgctaattaattttttttttttgtagtgagtacatattagaaagaaaaaaaaaaaaaaaaaggaaagtgttgaagtcgtaatgtgtacaacatatgaagtccataacctgccaggtacaattctttaaagaattaaaatggaagaagaaaggtaaaagcaaagattgacaacaatttttttgtggctcgatgaaaattattagtgtcaaagaaagaaataaaggtaaaaaatggcagaggaaagaatcacctttgggaaatagccccttcacaaagactagagtccaaaattacaaacatcaaaagatctttggtcggttctactgtttgcatctcttgttgttgctttcgtcttgtgaaaaatcattgaggtactatgtaaatttataatcagttttttaatcttattgaaagtttcatagtgagaaggaatttat

SEQ ID NO: 157 - DNA, 5000 bp, Artificial Sequence
  Description of Artificial Sequence: Synthetic polynucleotide
gtactatcagaaaagatttaaatctaaccttcgttataatttgagtccaaatatacccctgatgctatactattggttcaaatatattcttttccattaagtttgtccaaagtggacatccaatcctacgttgcactgacatttgatgatgtgggtgtcacatggcttgccacctcagcgccccaaatccatatattagagactaaaatttgaaatacaataatttttcgtaatggtggcaatagtgatggaagggaagaaaattttagtggtggaaaaaaaaaatagaaggaaggggtaaaataggttatgagcgctgaggtggcatgtcacctcatcaaacgtcagtttttcgtaggattggatgtccaccttggacaaacttaacagaagatgggtatatttaaaccaatagtattacggcaatgatatattttgacccaaagtataacgaaagatatttactcatagtacaacgatacatttcgtcatttaccgaatttcgaatttacattctcaaagaactcataactttgatgttaactaattaagtttaaactttagatcaccctacaattgttgggagacatatcaaacccataccattgatatatataagaactttgtaaaactctttttaatatgttagggtatgtactagctagcaccatggatagtgcgtgtcaccattttacagcaaataatatgcctcatgaattggtagggaaagggtctttaaagttgaagtgtttttttctttttcttggtaggtagtgggggaggggaaaataaggggacaaaacacaaaatcaatttgagtacaatttacacaagtctccatatattgatatagtgctgaaaagaaatataatgttctaaggcaaaggggataacacttagaaattagccaacctcatgtttcttacaagtggatgagggttcgactttgcatttagcatcaccttattctctctaattttcaacaggacatgttaataaaaggatgacaatccagattgacaaagttatgaaagtgaaagcactgtaacatttcattcaatcatgcaagcatctcccgttaatttttctatcttttggaatattacgaaaatcaaaccaacctttttacgtataagtttctaatgacatcagggggactcctgagaaatattctcactcaaggtcgaaaaggaccctttaataatgatcaatataaattttttttataatggtcctttaatattcgaatcagctcgtacacatctcaatttttgtaatgagtacatgttatccccgacaatatatatataagataactttgccctcaagaatttatatcgacagataagagatcacataatatttttgtctttgttggaatgtaaactctacttttatgaaattttattaactggtaggtcacatcctacagagcttttagtcaatgttactattattaagaaggaaaaaaagaagaagcaaaaggaagatattaacaatagtataacaacattcataaacgtgatttaggaaataaagtatggaaaaatgaatagtgaaaaaaagtcaagtacttaggagttaaggttcgtaagttgatgggacagatcgcggtggaaaaggaagataagcttcaaagatacaaaagcaaaggggggttgggttgagattctgagttgtgattaataccactcatgaacaaaaagttatgtcatggcaccattcatgagattaagacaacggtggaattaagaattttattaaagggagtcaaattttaaaaaaataaattcatcaaaaagttaaagagtatcaatatatatcaatatatatatatatatatatatatatatatatatatatatatttatattaaattatctaattacacagtataatttttaacgaaagggtgtcgatcgacacccttgaatgcatgtggccccgccactgcattcagagccaactctcccccaaaagaaaaggcgcaaaacaaaaggatttgaaacagtagttgtggaggtgattcagccatgctttcatgactcatcaatacctactttttatgtttttctttttcctttttattttcaggatataaattttgttgtaaactgatataaagaaataaatttactctcttcaacctattaagcttttaggtgaaattagtaagtcgtacaatttaacatggtgtagaattgatagaagtcgtagacactcataggtgcactttgtagtgaaaattaggagaaattagggttcaaaatccaactaagataaaagatgcttggtaatttcttcacatctgcttagaaataatctgcttaaatttggatgagcaaagttatccaatacaagtgttgctgagaaataatcggtatctaatagaatagtcgagatgcacgcaaataagttttgactctactttaacaaaaaaaacaataggcagatgtatccaaaattcatatcttatggtcactcgtcaacaaaaatattccttatgtttagtccaagaaaaataaccatacccaaatataagggtttgttgaagacggaaatatataaacaaataaacaaatatcatcatatctccgatagtttaaaattttagattggatatttcacacaatttatcaaaattttcaaaaaaaaattctactttttcttgcttggaacttggaaggggaaggggtggtggtggagatagggcggggcatcttctatctagtctatgtgattaatataacaaaacaaaaagggcgaggcaaaaacatggatgaatggtggtccttttctatatttatatggattgttacgatacgtcgatttcactttgcaaaataccaattagattcatttagttatctttttgatcactctgcttttactatcatatatatataggagtccttccacgtttcgcatgtgtcattgtttatattttccatggtcttccttccaaatggctaaaaaaatttgacacagtggtcccaaaagtttatagaaatagaattcaacagtgaggcatatacctatgaattctattttacatcttcatcgtataaaatagaatgtgttataaactttacctcgtgatgcttacaaggggtgaaaatataaaagcactttatagatttacaagagtcacaccttgatttatcctaagattttatttttttacatgccaaacaatgaagtatgggagatccaattggaataacatcaaatttaataaaattcgaaatagtcagagagctgtctactgaggtatattgaaacttatttttttttaatagaaaatatcaaatacttagcaatatattaaaatgtttcataaattacattgtttaaaccaagcgttgaaacatatgctgatacgaggtaggcttattgatgaatttataagggcctcattggaaaagacgatccaaagcaatgggctaaaaattggcccattttctgccacccagtgtatggttattactagtttcacccacacagatttgcacttcattagaggacaatgttgctgaatttgaaacataagtccatttatctccactgtacagtccttcctggagtccaatcctgaccatatcttcatgattttatgtaatgtggtgaataagcaaagtttcatgttatgctttgtctcattttatagcaaattcatttcctcataaaatttacttcaaaaaagtttcgtttgattttcagaaatcaaaatatgcttttcggtaaccaaatggttttcaattttgtttacgaagaacttaaaactttccaacaccctacatctatgattgcaagttaaaattgcagaaatatgacactttttggagtggtctttatcgtttaacttcacttgcactttaagggcaaaagttaaaagtgtttccatgaagcaagcgagggataacacttattaaacttgaaattctactcatagaccaaaacaaggacaaaaattcaagactatctatgtgggtaaacgtacgaaaattgggcttctccagattagagccggaccttgtggaaagacagagaaattcgaggcccacttccagtttctaaggagattaagcctatcaaacgatggtccagaacgaaatatgtctttctttattctctactatatagctgactcagaatcgttagaatttgcaatttcctcataataaaatgtgaggcagtatagattcgaaaacctttgttgaagattattgactcagctacgcgaaacaaactgtagtatccaatgtaccgattaacaagcgactggttaactatgaatttgttagctcgacaaaatcaccggttaataatgagtttgtgagttcgataaaatctaattttctgatagaaattttatatattatgcagaaatttaataaaagtagacttaacttatatattttagcattgactcttttgaagtaaaatccattccatctaaattatgacttccctacatcgagtaagtaagttgcgtctgtatcctcattttacccacttttcgctatgcaattattcaaggatctttacacaaatagcaagccaatattaattatttattttttttagtcatatatataaattatacatatattatatacccattaattatttttaatttaagtgatagattggacgactatttggattaattcttcgttattcaagataatagatgtcgtctctaatacatgagctagaagataataaggattactaggccgaaaggctgatggaaatgaacaagaagataagctcctaaatggaaacagtacggaaaaagtcaaagagcagtgcatgggaggaatcatcagtcagaaaaggaagccacgtgtcaagtagaaacaagcacgtgtccatgcaaaagccacgtaactcccttccatcacatcttccttcttcaaaacctcgtgttttactctctcttttctcactgccagtgatcgtcaggactgtgcatgtttgtttaaaaactaaaggca

SEQ ID NO: 158 - DNA, 5000 bp, Artificial Sequence
  Description of Artificial Sequence: Synthetic polynucleotide
acatgacccggttgtctcctttgtggtgtctttcagaacatcgccagtagttcgttgatgtggtgttgagtgaatactttttcaatatataagcaatttcgtgccttttttggttcattttgaggcttatgtaatatatttgatcatgtaatcgtgaatacttcaataaaaggtaactcttcctcagataatgtaaccaagaataatttcattgaagggaagcggtataagcataaaggtaactttccctgtgatgaagaatgatgatatcaagtaggcgttgttgatcaactttccaaatgggtggagggtaagctacttcactgccttacttcctctaagttcaagttgggggaggtatgatcggggattctctatcttcttgttgaacaagaaaacagtactactacttagcatatatagtttcaatcaataaataggaactgtactaacaatcagagcccttattttcacttagcatagttgtataccagttagaactcatactgtggaaacagagactcgtggactagcaatgcccttattaaaaactatcatggatgctctactcattgtctctccaaacaacagcactctttcataaaaaggtacttcatgcgacatccattaatacaagaagttcaagatacataacatgcagtaacagaactcgactcaacttagacttatcccacatctagcttgattttccatcaaaccagtgtgcgtaaaagtaaaacataactatagaattgatcccatggttaatcacattcacataacaagcggttgggataaaaagatggtcagttctaaggcttcaaaattaatatagccaattagtcgaacggacggtgtgcaatcctagatgacttctatgaaagtgagacgaatcaatctcccaaaagtttagtacaaagaaataacagcaaccgttcaaacaatctaatacggctacacatattaatcttcacaaattaaacattacaacaaaagcatactaaattctgaactcagtaaagattcaaatcaacagcaccatattatagacataacaacactagtgaattggtcatcaaagcaacgaagagcacagaaaagttcgaaatttaaccaatcacgaacctgatcgaagctcttgtggaacatctacacgcttcctgacttgtggagacaagagtctcgagtagattcggaaactgcccagtctaattttgatacgtattctacaatttccttactaaagagaaaaagagaaagtgtgtgagaatataaaattggcgccttctttcttttggcgctatttatctagttttagcgaccagttatcatgatttttaaagatatttttagattgccaattttcgctgagaaaaaaaggaggtaaaaggggtggtagttaaaagtgataatcaactttatataagactagtcttaatatacgtgcgttgcgcgtgtcataaaaaatattttaaaaaatatatttgtgttataatataaaaattaatacaaatttgcaagcttcaaaataatgaattaatcatatttaggagtttgatccactctagtggtttttggttcatcttgcttcattgtacaaaaaatttgagtatacttccaattctaagtcgttctattgttcaaaggaaaaaaagtgtcctaattgctcttcaacttctaaaatattgcctatctcttaccttaaatatgaattatcatttctgcgtccatattttttttttaaatcaaaattgtctttttcgtttttttttttttagaaaactatactctatagcccacaaaattttaatagctcatgtcttttctcacttacacgaaatggccctttggcccaaacataatagaccgaaatgtctattttgtatattttttgtatagtgacagtctattttgaatatttttttatataatgacagtctattttgtatatatattgtatagtgacggtggggagtgggttgctctagtggtaagcaccctccacttccaaccaagaggttgtgagttcgagtcaccccaagagcaaggtggggagttcttggagggagggagccgagggtctatcagaaaagcctctctaccccagggtagaggtaaggtctgcgtacacactaccctccacataccctactagtgggattatactggatcgttgttgttgttgttgttgtattgtatagtgacggtctatttagtatataattgtatagtgtttgtatattttttgtatagtgacagtctattgtatataaattgtacagtgacagactattttatatattttttgtatactgacagtctattttgtatatatgttgtatagtgacaatctatttattactccctccgttccaatttatgtgaacatgtttgactgggcatgaaatttaagaaaaaataaagacttttggaatttgtggtcctaaacaagtcaaaaggaggtccagagtatttgtggggttataaaagcttctcattaagggtacaattgtaagtttaagctaaattattatcaaatttagaaaagggtcattctttttggaacagaccaaaaaggaaataggttcacataaactggaacaaatggagtatattttttgtatagtgagagtctatttttcatacttctatgctaagtattgactttaaacactgttcaaacttaaacgtgtctctttcgcgtgaaattactctatattgaactactacaactatttgtgccggattttgtcaaaaaattcaattttccggccaagttcgttctgcttcctcctcccatccttccaatcttattctttctgccacttttcagcaatagtgatacaactaagatatgttttaaggttttgaactatttgtgtggaagagttttatggcatatactttttctttggtcgttgagaagagaggtcgacgtcgctcatgaagacattctgccgccgacgaaacagatcttatagctagccgctagaattattttaggctataaaatgtatattataattttggactactggatgatatatgttttgggccgatgggctataaatgaattttgctcatttttttaacgtgttctttattagcataaaaattgcaggatgagtttgttactttaatttcattaatttactctttttttgcagaatatacatacatgaaaagtaacatgtagtaaatattattatgttacatatatagtttaaataaaggaaaaagttaatgtaaggtagaattttaattgactttaaattcctaaattttaggacttctcacctagttcaaataagtaaatatttaataatcagcatcttagttaatttcaaagtactaaatattatgataataattaaatgactattttgtctagtcgaaatctattttttaagggtaaaaaaagcgaacgatatttcgctaagaaccttcgtgcttttaatataatactagtttctatgtacgtgcgttgcacgtaaatctttagtttatcatttatatgaaaaaacaatacattaaatttactggaaaatcatatacaaaaagaccgaataaagccattaatgtgggaacaatgcaatagtatcgtcaatgggaacatgcattgcacatatattccgtgtcaatagttatctttgtgaaataaaaaatgatacatgtaattttatactatcattcatattatgaataaacttgtttgatttttaaaatagaaaataataaagagcacgaaaagttactgctagtcattaaaatttgttatgaacattgactctattatagaataactcatcaagaagaattttaagtgcaatattgaaggatttgctttagtttctaatagtataaatcgatgtctcttatcggatcataaaaccaaaagaactataatgtccatacaactccctatgtatgtttacaatttgctttgtgtgtgtaaacattagaacttttcacctaaatatctcatacctcttaagaaagaatccttgctggatacttttcttttggagcttcacaattataagttaccaattaactaatctctccaagcctctatttaacatatacacgtttatctctggacgaacaaacaatagatggcgtcgaagatccactcttcatcttcctgattttcatcaacttccttatgcctatttatttcttgttttcagttaattcgacaaattaaattagaacaaaatccattactgctggttatcagacaaagaaaaactaaagtaactccttttgccaacaccaatgtagaacataaataagcttaaaggtaatttcttttaaattttaggcaaaacctttatgtaaacgaacatttaagccgtggctttgccattggagttctaatacaaataggacctttagttttcaatgacttgaattctacaactaatgaactgtttttacgtttttggatattaatgttgaagacatgatttaaatatgaagggtaaaaaagtcggtcaatatttcagggacatttttgtcgttcaatatttagcgtgtaacattcgtgtttttataataatatagatatagatatagatttctctccccaaccccgagattttttaaaagtattttaaaatagggttactgtgcacatataagaatcagaaatttccaggaccatagcaatgagcattattgaacagtagtagtacgtatgtcctttctggtataggatatgtagcttcattaaaagatagaaaatgaaaagcgtataaagtttgtgatacatttactaataaatccaacgaataaaagaaatactcgtatataaaagtagaaaagtaagtgtttgtactttttataaaaacacaataggtggagttgagagggatatggaaattgccttggatattatgtaggcatcatgaaccaattaatgggacctacaagattaatgttttggctatccttatcttttattgacaggcccttcaatttaaatcgttgctgcccaa

SEQ ID NO: 159 - DNA, 5000 bp, Artificial Sequence
  Description of Artificial Sequence: Synthetic polynucleotide
ccgactaacaaaggagtcaaacaatggcgaaactagaaatttacccaagggtattcaaatttaaaaaaagtgaaaacaaattcctacaaagggtgtttaatatgtgttatatacttctaaaacgtaatatttatctataaacacaatgcaatttttcaacgaagagtgatcaactgaccaccttataaccgccactggagtcaaaccctagttttcttttttagcttctttgtattattggtagaggtgaaccattttatacaaacatacatacatatatgtgtgtgtgagagagaaactttataaaaatagtactatgaatattgaatatcgaatttccattctcaaataactcataactttaatgttaactcattgtaaaaccttttttttacatgttagggtctgtactagctagcaccatggatagtgcgtgtcaccattttacagcaaataatatgcctcatgaattggtaggggaagggtctttaaagttagtgtgtttttttttctttttcttggtaggtggtgggggaggggaaaatgaggggacaaaaaaaatcaattggagtacaatttacacaagactccattgtatagtgctgaaaagaaatataatgttgtaaggcaaagaggataacactttagaaattatagccaacctcatgtttcttacaagtggatgagggttcgactttgcatttagcatcaccttattccctctaattttcaacaggacatgttaataaaaggatgacaatccagattgacaaagttatgaaagtgaaagcactgtaacatttcattcaatcatgaaaagcatctcccattaatttttctatcttttggaatattacgaaaatcaaaccaacttttttacgtataaatttctaatgatgtcaggggaactcctgagaaatattctcactcaagttcgaaaaggaccctttaataatgatcaataattttttttaatggtcgtgtaatattcgaatcagctcgtacacatttcaattattgtaacaagtaccttttatcccccaacaatacatatataaggtaacttatcacgtaatatttttgtctttgttggaatgtaaatcctgtttttataatttttatccactttattgaccgctaggtcacatcttatggagcttttttagtcatgataaatattactattattaagaagggagaaaaaagcaaaaggaagatattaacattagtataacaccattcataaacgtgatttaggaaataaagtatgaagaaatgaatagtgaaaaaagtcaagtacttaggagttaaggttcgtaagtagatgggacagatcgcggtggaaaaggaagagaagcttgaaagatacaaaagcaaaggggggttgggttgagattctgagttgtgattaataccactcatgaagaaaaagatatgtcatggcaccattcaggacatacagagccaactctccccccaaaagaaaaggcgcaaaacaaaaggtttgaaacagtacttgtggaggtgattcagccatgctttcatgactcatcaatgcctacttttttttctgtttttgtttttcctttttattttcaggatataaagtttgttgttaacttaaataaagaaataaaattactctcttcaacctattaagctttaggtgaaattagtaactcataaaatttaacatggtatgaattgatagaagtcgtagacacccataggtgcgctttgtagtgaaaattagggttcaaataagataaaacatgcttgatgatttcttctcatcggtttaagtttggatgagcaaagttatccaatacaagtattgccggtacctaataaaatactcgagatgcacgcaaacaaattttgacactactgttaacaataaacaatatgcagctgtccaaaattaatactatatcttattgtcactcagtcaacaaaaatattccttatgtttagtccaagaaaaataaccatacccaattataagggtttgttgaagacagaaatatataaataaatgaatcatcatatctccaatagtttaaaatttcaaatgggggtatttcacacaatttatcaaaattttaaataatttttatactttttcttgcttggaaggggaaggggtggtggtggagatagggcggggcatcttctatctagtctatgtgattaatataactaaacaaaaagggcaaggcaaaaacatggatgaatggtggtccttttctatatttatatggattgttacgatacgtcgatttcactttgcaaaatacccactagattcatttagttttctttttgatcactctgctttttctatcatatatataggaagtccttccacgtttcgcatgtgtcattgtttatattttccatggtcttccttccaaatggctaaataattttgacacagtggtcccgaaagtttatagaaatagaattcaacagtgaggcatatacgtatgaattatattttacatcttcatcgtataaaatagaatgtgctataaactttacctcgtgatgcttacaaggggtgaaaatataaaagcactttatagatttacaagagtcacaccttcttgatttatcctaagattgtatttttttacatgccaagcaatgaagtatgggagatccaattggaataacatcaaaattaataagattcgaaattgtcagagagctgtctactgagatacattgaaacttatttcttttgtacaacagaaaatatcaaatatttagcaacatattaaaatcttcataaattacattgtttaaatcttacgctgtaacatatgttgataggaggtaggcctattgatgaatttataaggtgaaaatacatggactagccagttttcgaactagtaattgaaaaaaggtatattatcacttttagcccgcgccagaaattatttatatttggtagttgaaaaagtgtataaatttgtaattttttgtatataacacacataatgtgtgtgtgagtgtatatatatacacacacaaaaactatatatattttttctattattttgagagtggttatacagtgtcatctttctaatcgaaaatagccagcgtttgcaatgttattaaaaaaaaatagccactattttagctgaaacacggaaagttccagcataatatatcggatttcagagctcctgcatataaacttccagcacattatgaaattccatcacattatgctgaaatttttccggattcttaaggtgttttcattcagattttatctttacataaaaaaatggctaaatttcgattacttttgaaattatagctctttttcaattactaattataaatctgactatttctgattttttgcctctggtcaaaatggcatggcatagtcatttttaggggtggttattgaaaaatagctagtattcacaaagttattgaaaatagtcattatttacggcgaagattaaatcttaacaaatgtacctgagttaaaacacaaaaagttacaacataatatgttggatcatggaactccttcatgtatgcttctagcatattatgttgaaactccagcacattatgaattccaacacattatgtcgaaatctcatatgtaaaaaattcgaactctggcatattatgctggaattttttcgtattttttatcagattttattttcacataacaaagtgactagatttcaataacttttgaaactatgaccaattttcaattaattgtaaatcaaattatttctgatttttttcctccagggcaataatgggactcaactttaggcaacaaaaaactgtttatgtaggtaaacgcacgaaaattgggcttctccagattagagccgggccttgtggaaagacaagaaattcgaggcccacttctagtttctaaggagattaagcgtaaaaatagcactggctagccagttttcggactgatcattcaaaaatagccagtatttgcaaagtcattgaaaaatagccattagtattttgctgcaacacgaaaagttccaacataatatattggagatcagtgcacctatgtatgaacttccagcatattatgctggaactccaacacgcggaaagttccactataatatactggagattggagcaccggtgtcaacaaatctatcatttaataggatttatggctatttttaaatgaccacttgtaaatctgattattttttaatttctcccgcttaagcctaaccaacgatggtcatgaacgaaatgtctgtttttactctctactatatagctgacccagaatcattacaatttgcaatttcctcataataaaatgtgatgtagtatagatttgaaaacccttgaagattattaatttatctttcgcgaaacaaactgtagtatccaaggtaccgaatagtaagcgattggctcacaatgagtctgtttgttcgataaaatcattggttaataatgagtctctgagttccatacaatctaatgctctgatagaaattttatatatatgcagaaagtaataaaaatagactatgacttactatattttaacattcactcttttgaagtaaaatcccttccgtcaaaattatgacttcattacaccaaattgcgcctgtatactcattttaccttctcttcactatgcaattattgagataaaaaatttcgtctctaagacatagctagaggataaggatcttaggccgaaacactgatggaactgaacaagaagataatcacctaaatgggaacagtacggaaaaagtcaaagagcagtgcatgggaggaatcatcagtcagagaaggtagccacgtgtcaagtagaaacaagcacgtgtccatgcaaaagccacgtaactccactccctcatatcttccttcttcaaaacctcgtgttttactccccctttcctcactgccggtgatcgtcaggactgtgcatgtttgtttaaaaattaaaggcg

SEQ ID NO: 160 - DNA, 5000 bp, Artificial Sequence
  Description of Artificial Sequence: Synthetic polynucleotide
acatgacccggttgtctccttggtggtgtcattcaaaaaatcgccagtagttcgttgatgtggtgttgagtgcatactttttcaatataagcaatttcgtgccttttgtttttccattttgaggcttatgtagtatatttgatcatgtaatcgtgaatatttcaataaaaggtaacttttccttagataatgtgaccaatgatgatctcattgaagggtatacttttcctgtgaagaagaatgatgatactcctatcatgtaggcgttgttgatcaactttcccaatgggtgaagggtaagctacttcactgccttactttttctaagttcaagttggtggaggtgtgattggggatcctttatcttcttgttgaacaagaaaacgctactaattagcaatgaataggaactgtactaacaatcagagcccttattttcacttagtatagttgtatgtataccagttagaacctatactctggaaacagggactcgtcaacaataaccagaagggtggattagaaactatcatgaattccctactcattgtctctccaaacaacaacactcttttataaaaagtgtactgcaagaatcatgttatgcttttaaggaatgtgcatcaagattgaagtatcatgcgacatccattaacacgagaagttcaagatgcacaacgtgcactaactgaagtcgactcaacgtagacttattccacatctaacttgatctttcataaaaccggtgtgcgtaaaacattactatagaattgatcccacggttactcatattcacacaacaagcaattgggacaaaaagatggtcagttctaaggcttcaaaattcatacagccaattagtcgaacatgcggtgtgcaatcctagatgacttctatgaaaatgagaccaatcaatcttccaaaagttcagtacaaagaaataacagcaacccttcaaacaatctaatacaacgacacatattaatcttcacaaattaaacacaacatcaaaagcgtactagattttgaactcggtaaagaatccaaatcaacagcaccgaattatcgacataataccactagtgaattagtcatcaaagcaacgaagagcacagaaaaagttaagaaatttaaccaataacaaacctgatcgaagatctcttagaacatctacacgcttcccgacttgtggcgacaagagtctcaagtagactcggaagctgctcagtctaattttaaatatatattctacactttcctcgcaaaagagaaaaagagagtgtatgagaatattaaattggcgcctttttcttttggcggaattgttctagttttagcgaccagttatcatgattttactactatgtaaatcgcaagcattaaagttatagcaagaaatgagaccgagtgacctaaaaacaatcacatttgtatgtttcggttccacgagcagctctgggcggacctagtaggagctcctttgcactgttgcaggagtgctcaagtacctttactctcttggtgactcagacactactgccatatcaatgagaaaaaaggaggtaaagtggtagttaaaagtgataatccattttatataaaatccctccccccgcccccatacccccggaattgtaaaaatatttttaaatagtgttactatgcgcatatactagtcagaaatttgtaggattacgggaggtagtacgtgcgggtgtacaaaccaaatcggaaaatcgcaccaaaccgaaaagtcaaatcaaaaccgattaaaagattcgactagatttggtttggtattgagtaaaacaacccgaattaaaccgacatataaatataaatttttatgtatacttttaagatttttatatagaattttctttaagaaaatatctaaaaatatttgggattctcttacgggatataatatttaataaaatatgaagtgctccatatttattaaccttaaacaatgggtcgtatgatcactttcttatcaagtgttactgaaatgcgtcaatctctttgttcttccatagtcaagatctattaaattcttatatctttttcgaatttgaagtggttattattatttaagtatcatattgacttttacgtttaattactaaattcggttaaccttgaaagtgtatatcaacaaaaattattgtcggacgactaaaagactaactatcatgtgttattaagtaaattcacgcataagaatatttaatagataatatatttttctaatttttaaaatttttactaaatatatttacttataaaaaatttaacaaagtaagattgaaataatatttaagtaacgaaaaaccagccaaaaccgatatagtttgtgtagtttgatttaaataaaagtcgaacccaacccgatccatgtacacccttaatagtacgtatgtcctttctggcatactggtaggatttgtagctgcattaaagatagaaagcgaaaatcgtacaaagtttgtaatactagtacattactaataaatccaacggataaaagaaatatataaaagtagaaaagtaattggtctagattttatgaaacacaataggtggagttgagaggggtatggaaattggcttggatattatgtaggcatcatgaaccattaatgggacctacaagattaatgttttggatatccatatcttttgttgacaggcccttcaattgaaatctttgttgcccaaaatgattccactgtcaaccaattataagttttttgttaaaaggtttattgcaccattgctccactaacttcatgtgcatttgcaacttaccacacaagagagaagaaaagtttccagtacacaggattaacatttgctaagttgattcggagttttagttagcaaagttgaaattatcaaagacagattttgaaactataagccagtggatcgctaaggggttcctcgttgataaatacttattttcatctggtgtttatactaatccaataaatatataatatatgtctttacaaatatggttataattaaatcataattaattagtacacattgttacctcacgttatcactttaccatgataagagtttggtataaatactggtgggactaagttttttaccttcctcgtttagtgtctacaagcctaattaggtgaagatggtgctggatttttttttttttttgttacaagtgtagactacagaaattaaattactggtcctattgtgcaaaatttgaattcaaatcttcgtgcatttcagtatgttatttggtacaaaaaacatggcatttatggcttcgcattgaggaagaacttgtatatagcttgaatgctcttgttacatccaccctccttaaatacccctagttgatcaacaggcaccaaaaatgtctagacacaaacatgaaccagttttatttctattctctttattgtaggtaattgtttgctgtcatcatataatataagctaggaagaaaataagtaaaaatcatcagatgtgataggtcttgaatagagaagcaaacctaatgtagcataataagaaaggaagattaggtgggagaccattatttatgacctcatcccaattttaatcatatttcattattccaggttactactaccaaacaaaaataaacgacaagaataatgcataaacttccacaatagctcattatttatttatcagccggagtgtattaaagtaatgatataattagaagacaattgagttgctacttaaactgatgctaacctgacgcgttttcgttttccaggtacagtcttccaacatcagatgtcccaattggagttccaagtcaaagtggaattggaaaatggtaagaaaactctcagccttagctgtgacatagacatcaataaagtagaaaaaaatcataagatttcaatgtttgaatgctaagcgacacaaaaatcactaaataatttttttcatttctgactaagtctttatgagcaaaactatttattacttacaattttgtgatgataggagatatcaaatactcgtggaatacttgaggtacccacaaagtgattgagaagttgctgttaattaaaaaatccttgcatcagatcccttcagtttgaggtcaaaagcacaatcatgaaaagccctctcacagcacattcacttgatccattctattttacgtcttttctctaactacgacttaagttcttctaacttttaatcattaccaccctattaaaacttatctaaagactgtttttctctgcttttctccatatttacctcaacgtctccttccatatccaagctttggtactttttccccttgtggtattgattcaggcatggtcccttctccaatcttatcaatcaaacatatactaataaagtataatataccaccgactttggtgtcaaccacgagttcgggagcttgtgaaatatggtggtatttagccaatttttttctttttaataaaattgacaattaggaaccaacttgccggcttcataataaagtatatagttgaaatggttcagaaatattaaattcaattctataaattacttggattcggtccatcctaaaggtggtcacttctaggatcaagccccattgttggctaaattttggttttaaatagattaattagcttggagtcgaacagcaagcattaagtttaccaggtctatgatttagttaggcatgaattgtaatacaaagatgatttatgcagtgattaatgatatcaggatatatatatataagtattgttatactataaataacaacaacaacaacgacccagtaaagtcccactaagtggggtttggggaaggtagtgtgtacgcagaccttatccttaccctgatagggcagagaggttgtttccgatagatcctcagctcaggaagatgaaaataaaacaagaaaacaagaaaagacagtaaccatagaaataatgacagcatcctaaaaaccataaaatagatga

SEQ ID NO: 161 - protein, 524 aa, Artificial Sequence
  Description of Artificial Sequence: Synthetic polypeptide
MIGYPKRFTLHGLWPANSTGYSLKCAPPPEGTSVWTTDGQLRTALQKCWYSLIRGRPNYILWKHEWKDYGYCSSHTIKDTDYFWAAVRKHGRNTKIAGDAIVNELSDAEISPSNDKERRCETESDSSHHYQHSEHHQRRWLGRRRECDTKRYSQAKYITSPHESVTASREKRASTSTIEEAPPAVKKLLLEWLTSTINNIFDKPAQKENGNTAQADIVTTTGEQPLPRTGNTYPTMDAGAKKAEARVNDIFAVRQSSGEGLRDFLARFNREEIHNAYCAKERADDDDLNGPIQRLTSVQEESRSDHRNDSQRDQSGPRLSRERHQHYVRTTVLPSPRHMEGPPRPYIGTQRNERGMPPLLSTHNFCVSPSKIVYALKKLGTMVKCPQKMKSGPNTQKLNAICEFHQERGHKTEDCIGLRQEVVRMLNQGNLKELMSDRGRVNFARGRELPQGPPKPPSPARTIQMIIGGGDEAMINHMKFTTTHKLKRSMTHERYDDFGDSIIFDKSDTDGLTFPYFEAIVITL

SEQ ID NO: 162 - protein, 343 aa, Artificial Sequence
  Description of Artificial Sequence: Synthetic polypeptide
MSCQNSKTEETADEQHNTSKDPKHKPFFDVYGPQGRADIVFNQPESNSTLNLQDVQGLVTWVLADGFMPSWAFIKNKPLIPKVVMLYVPGLDAALYLSQSKVLKGFKECCGIPRPVLALSCVSDGNQTIDALLTYKSKRKRKEAEHISPINTEPSEQGAETPTMEPLSFVDLKKDIPFPISYYTLTDKELEENGYCYDQPEFLSTLPAPSGTSPHEILALDCEMVLLDKLVKPSNNIVDYNTRYSGITCQMLEDVTTTLKDIQEEFLKLVYKETILVGHSLENDLLALKIIHNLVIDTAVLYKHPRGSYKAALRVLSRKFLGREIQDSGNGHDSIEDAKLHWN

SEQ ID NO: 163 - protein, 723 aa, Artificial Sequence
  Description of Artificial Sequence: Synthetic polypeptide
MASTSYITFKPLQQTQLKLYYFTHCSKHSSTLFHSSFHTLLSAPTKYTLEPPRILPSIQVKAHVTHLETRLSFEPEQEISGSRTNNENSSGFSSFSPKDKMVGMKSSRENLDRHCQTLDELVQLFKSSAEASNTKSVRGEQEDHGIKVSEEVKHYALKYGFKIYEKMRSEKVQMNEATLTSVARMAMALGNGDMAFDVVRLIKEYGINPRLRSYGPALSVFCNNGDVDKAFMVEEHMLEHGVYPEEPELEALLKVSVEAGRSEKVYYLLHKLREGVRQVSPSTADLIEKWFNSKIASRVGKRKWDERTIREAIKNGGGGWHGQGWLGNGKWTVSHAYVDSDGCCKCCGEKLVTIDLDPVETENFAKSVASIAAQRERNSSFQKFQRWLDYYGPFEAIVDGANVGLYSQRKFRPSRVNAIVNGIRQMLPSKKWPLIVLHNRRITGDKMDEPFNRAYWLYAAIKFKCLIVTNDEMRDHLFQLLGNDFFPKWKERHQVHFSFSETGPVLHMPPPCSVVIQSSERFGPDRRIYHGRSSRTLKDKELSGSRDSGYPRLSDYNFNINLIELVSVMRNIKEARFPKPIRSYSSQKDHFKIKRVLVDPGSSANIIQLRVLEQAKLIEVPTMKLLAGFNLTSVTTQGEIVLPTYAEGVTKSTLFKVVDGDMGYNVIIGRPWIHKIKVVPSTYDQFLNFPTSDGIKQIRGDQPAAREMNVVTLSSSNAEEINK

SEQ ID NO: 164 - protein, 155 aa, Artificial Sequence
  Description of Artificial Sequence: Synthetic polypeptide
MQSPESCVIVSCPTTLIADEDEEVADMETSVKAVEEILNYKFIKPKLLEEALTHSSCIDSVSYQRLEFVGEQAEFHGGAMKAPKVLADIVESVAAAVYVDCGFDLKNLWLLLLRTKKMLTSRCKAALQKLAFKSIGKTDLKLNQIQRLMGQAKAA

SEQ ID NO: 165 - protein, 234 aa, Artificial Sequence
  Description of Artificial Sequence: Synthetic polypeptide
MKPQKSLLIKVLITQCLLVLCVAQQDFDFFYFVQQWPASYCDTRRSCCYPTTGKPDEDFSIHGLWPNYENGKWPQNCDRESSLDESKISDLISTMEKNWPSLACPSSDGVRFWSHEWLKHGTCSALGERAYFQAALDFRKKSNLLENLKNAGITPRNGEHYTLESIKKAIEEGVGHSPYIECNVDTQGNHQIYQVYLCMDKTATDFIDCPVFPHGRGCGSKIEFPPFSSDHDEF

SEQ ID NO: 166 - protein, 217 aa, Artificial Sequence
  Description of Artificial Sequence: Synthetic polypeptide
MATRRREADFDFFYFVQQWPASYCDTRRSCCYPTTGKPDEDFSIHGLWPNYENGKWPQNCDRESSLDESEISDLISTMEKNWPSLACPSSDGVRFWSHEWLKHGTCSALGERAYFQAALDFRKKSNLLENLKNAGINPRNGEHYTLESIKKAIEEGVGHSPYIECNVDTQGNHQIYQVYLCVDKTATDFIDCPVFPRGRGCGSKIEFPPFSSDHDEF

SEQ ID NO: 167 - protein, 160 aa, Artificial Sequence
  Description of Artificial Sequence: Synthetic polypeptide
MGVTTYNQEVTTLVAPTRLFKALVLDSENLVPKLMPQVVKNIEIVVGDGDAGSIKKMNFVEGSPIKYLKHKIHVIDDKNLVTKYSLIEGDVLGDKLEFVTYDIKFEASGNGGCICKTSTEYHTKGDYVFKEEEHYEGKKQAMELFKTVEDYLLANPSVYV

SEQ ID NO: 168 - protein, 160 aa, Artificial Sequence
  Description of Artificial Sequence: Synthetic polypeptide
MGVAIFTQEFTSPIAPIRLFKALIVDSKSLIPKLLPQFVESVDLLQGDGGAGSIEQVNFTKGSPFEFVKHRIDELDKENMVCKYTMIEGDALADKFDSISYEVKFEESNNGGCICKMTTEYIGIGDFIVKEEDIKAGKDSAIGIYKAVESHLLQNPNLYA

SEQ ID NO: 169 - protein, 160 aa, Artificial Sequence
  Description of Artificial Sequence: Synthetic polypeptide
MGVTTYTHEVTTSVAPTRLFKAIVLDSENLVPKLMPKVVKNIEIIEGDGGAGSIKKMNFVEGSPNKYLKHKIHVIDDKNLVTKYSLIEGDVLGDKLEFVTYEIKFEASGNGGCICKTSTEYHTKGDYVFKEEEHNEGKNQAMELFKTVEDYLLANPSVYV

SEQ ID NO: 170 - protein, 160 aa, Artificial Sequence
  Description of Artificial Sequence: Synthetic polypeptide
MAITSFTDEYTCPIPPSRIFKASIIDSHNLMPKLMPQAIKSIEFVQGNGGAGSIKQINFPEGGNFKSIKYRIDELNEEKFVYKYTLIEGDALVDKLEKITYEVKFEQSADGGSISKVTSTYYTEGDFKLKEEEIKAGKEKVLGMYKAVEVYLLQNPDAYA

SEQ ID NO: 171 - protein, 229 aa, Artificial Sequence
  Description of Artificial Sequence: Synthetic polypeptide
MASNSATSLFLTLFLIIQCLSLLTAAQDFDFFYFVQQWPGSYCDTKQSCCYPKTGKPASDFGIHGLWPNNNDGSYPSNCDSNSPYDQSQVSDLISRMQQNWPTLACPSGTGSAFWSHEWEKHGTCSESIFDQHGYFKKALDLKNQINLLEILQGAGINPDGGFYSLNSIKNAINSAIGYTPGIECNVDESGNSQLYQVYICVDGSGSNLIECPVFPRGKCGSSIEFPTF

SEQ ID NO: 172 - protein, 229 aa, Artificial Sequence
  Description of Artificial Sequence: Synthetic polypeptide
MASNSATSRFLTLFLITQCLSVLTAAQDFDFFYFVQQWPGSYCDTKQSCCYPKTGKPASDFGIHGLWPNNNDGSYPSNCDSNSPYDQSQVSDLISRMQQNWPTLACPSDTGSAFWSHEWEKHGTCAENVFDQHGYFKKALDLKNQINLLEILQGAGINPDGGFYSLNNIKNAIRSAVGYTPGIECNVDESGNSQLYQVYICVDGSGSDLIECPVFPRGKCGSSIEFPTF

SEQ ID NO: 173 - protein, 240 aa, Artificial Sequence
  Description of Artificial Sequence: Synthetic polypeptide
MRSIQLVLVKLVIFQCIMLLHAQDFDFFYFAQQWNPASCDSKIKCCYPTNGKPAQDFGIHGLWPNYNNGSFPKSCNKNARYDETQISDLISSMQKNWPTLSCPSNNGTRFWSHEWKKHGTCSLSMLDMHSYFQAALALKEKVNLLQFLNNAGIKPDGGFYSYEAMKEAIEKGIGHTVGVECNIDLFGNRQLFEVYVCVDKCGSEIIDCPIVPESKRCKESIEFAVFESESLLDEKSAYSL

SEQ ID NO: 174 - protein, 265 aa, Artificial Sequence
  Description of Artificial Sequence: Synthetic polypeptide
MRSIKFVLVKLVIFQCITLLVHAKDLDFYRLTLQQWNPAACYNRIIGKCCNTTTGRPAEDFGIAGLWPSYNNLTYPENCNKAGPYDETQVSFDKIQISDLLSSMQKNWPKISCPSNNGTSLWAKEWKERGTCSRLNMHSYFETALDLKEKLNLIQDVKRYGTDLTHVHMHGLEPNGQFYHWRHINAAIKLAIGHVIAIECNLGLTADSQFYRVHICVDKSGSDFIDCPINLTEISETTCSSSTKWSGYDTDSVLEERSAYSWARK

SEQ ID NO: 175 - protein, 493 aa, Artificial Sequence
  Description of Artificial Sequence: Synthetic polypeptide
MGSFSFAVCVSLMLLVMVVAIPFEPKNGRRIGRLHRWWDPLIRSPVDRDDEVEDSNSVRWAVLVAGSNGYGNYRHQADVCHAYQILKRGGLKDENIVVFMYDDIAKSELNPRPGVIINHPNGSDVYAGVPKDYTGEHVTAANLYAVLLGDKSAVKGGSGKVIDSKPNDRIFLYYSDHGGPGVLGMPNMPFLYAKDFIEALKKKHAAGTYKEMVLYIEACESGSVFEGMMPEDLNIYVTTASNADESSWGTYCPGMDPPPPPEYITCLGDLYSVAWMEDSESHNLKKETIKQQYEKVKERTSNFNNYNAGSHVMEYGSKEIKPEKVYLYQGFDPATANLPANKIDFAHLEVVNQRDADLLFLWERYKKLADNSLEKAKLRKEITDTMLHRQHLDGSVDAIGVFLFGPTKGSSVLNSVRKPGLPLVDDWDCLKSTVRLFELHCGSLTQYGMKHMRAFANICNNGVSRDAMEEAFMAACNEHKIEEYIAANRGFSA

SEQ ID NO: 176 - protein, 494 aa, Artificial Sequence
  Description of Artificial Sequence: Synthetic polypeptide
MGSFSFAVCVSLMLLVMVVAIPFELPKNGRRIGRLHRWWDPLIRSPVDRDDESEDKDGVRWAVLVAGSNGYGNYRHQADVCHAYQILKRGGLKDENIVVFMYDDIAKSELNPRPGVIINHPNGSDVYAGVPKDYTGEHVTAANLYAVLLGDKSAVKGGSGKIVDSKPNDRIFLYYSDHGGPGVLGMPNMPFLYAKDFIEVLKKKHAAGTYKEMVLYIEACESGSVFEGMMPEDLNIYVTTASNAEESSWGTYCPGMDPPPPPEYITCLGDLYSVAWMEDSESHNLKKETIKQQYEKVKERTSNFNNYNAGSHVMEYGSKEIKPEKVYLYQGFDPATANLPANKIAFAHVEVVNQRDADLLFLWERYKKLADNSLEKAKLRKEITDTMLHRKHLDGSVDAIGVFLFGPTKGSSVLNSVREPGLPLVDDWDCLKSTVRLFELHCGSLTQYGMKHMRAFANICNNGVSRDAMEEAFMAACNERKREEYTAANRGFSA

SEQ ID NO: 177 - protein, 768 aa, Artificial Sequence
  Description of Artificial Sequence: Synthetic polypeptide
MYDDIANNSENPRPGVLINNPHGQDVYQGVPKDYVGEDVNADNFFNVILANKSGITRGSGKILDSGPNDNIFIYYTDHGGPGIVSMPTGIVYANDLINVLEKKHASGTYSKMVFYLEACESGSMFDGLLPEGLNIYVTTASKPDENSWGTYCGLGRGACLVECPPPEFDGVCLGDLYSVAWMEDSDVQDRQTSTLDNQYDRIACRTAANLTYGSHVMQYGDMELSVDALFQYMGSVSTSHSQAPSPMAAAPSPMDAASFLTSSENVNQRDTELFYLTSKYQGAPEGTNEEFAADRKLNEVVAQRSQVDNNVKRLGELLFGVEKGNEVLQSVRPAGQPLVDDWDCLKSYVKTFEAHCGKLTAYGKKHVRGIANICNAGIESEEMVDATAQACSAASEIGPNSPTFTQTDFILPPSHPLYLHPSDNPDPDISQSVIYSKSAKRLWDKLNQRYGQANGAKMYEVQKDLSTIFQGSSDVGSYFTRVKRLQDEMESLDADSFCVCECKCGGKHKMIKRMENQKLMQFLMGLNEERGYDPKMPYCRYCKKPGHVIEKCYKLHGFPRPSKSGNKNIRVAAHVHSSSDAKPNRSYDNNINIANTIIPDQYKQHMTILQHIQVGSNDSQSQFATANFAGIFASSAHLMSCGNCTCLSSVLTSETWILDSGTSVHMTFNKYSLTNITTLYVPYLITLPNGYKVKVTTIGSVKLNSSVILSKVLYVPTFKYNLILVHKLLVDTLSLLCFSQHACFLLHGPSLRMPLILGKCHNPKSHPS

SEQ ID NO: 178 - protein, 457 aa, Artificial Sequence
  Description of Artificial Sequence: Synthetic polypeptide
MVQKNGVVSFLVVLFVIVCTAEGRNLLESIVEDDNATGTKWAVLVAGSNEWDNYRHQADVCHAYQLLKKGGLKDENIIVFMYDDIAYNKNNPRPGVIINSPHGHDVYKGVPKDYTGKDCNADNFFAVILGNKSALTGGSGKVVENGPNDYIFIYYADHGAPGLIGMPSGDDVYADDLIKVLIKKHTFGIYSKLVFYMEACESGSMFDGLLPKGLNIYVTTASKPDEGSWATYCISLGDEDVVCLGDLYSVAWLEDSDLHDRQVETLEKQYQLVRKRTLNNGTVEGSHVMQYGDLHISEDPLFRYMGSNSAKNSYYSTSTNDESWLPSRTVNQRDVHLMHLWSKFRSAPEGSARKTEAQRQLREAISQREHVDNSVRHIGEVLFGVEKGPEVLQTVRPAGQPLVDDWDCLKSFVKIFESQCGKLTPYGRKHVRGFANLCNAGIRREQMAAAAKQACPS

SEQ ID NO: 179 - protein, 359 aa, Artificial Sequence
  Description of Artificial Sequence: Synthetic polypeptide
MIRKNGVVPFLVALFVLVCTAEGRNLLESIVEDDNPTGTKWAVLVAGSNEWDNYRHQADVCHAYQLLKKGGLKDENIIVFMYDDIAYNKNNPRPGIIINSPHGHDVYKEYPSGKVVENGPNDYIFIYYADHGAPGLIGMPSGDVVYADDLNRVLIKKHTFGTYSKLVFYMEACESGSMFDGLLPKGLNIYVTAASKPDESSWATYCIRLGDEDQCLGDLYSVSWLEDSDLHDRQVETLEKQYQLVRKRTLNNGTEEGSHVMQYGDLHISEDPLFRIWVLILQKIVIILHNNDESWLPSRTVNQRDVHLMHLWSKVKIFESQCGTLTPYGRKHVRGFANLCNAGIRREQMAAAAKQACPP

SEQ ID NO: 180 - protein, 301 aa, Artificial Sequence
  Description of Artificial Sequence: Synthetic polypeptide
MIPARMADVCHAYQLLKDGGLKDENIIVFMYDDIANNRENPRPGVIINNPHGHDVYKGVPKDYVLEDVNANNFYNVILGNKSAVVGGSGKVVNSGPNDHIFIYYTDHGGPGVVSMPSGEDVYANDLIDMLKKKHASGTYDRLVFYLEACESGSMFDGLLPEGLDIYVMTASEPNEDSWATYCGEGTPDDPCLVECPPPEFQGVCLGDLYSVAWMEDSTIDRLLFLTPHDFYSFFSECLQHQNAPEGSDEKFKAHARLTEAISQRTQVDNNVKHLGELLFGVEKGNEILHSVRPAGQPLVDS

SEQ ID NO: 181 - protein, 483 aa, Artificial Sequence
  Description of Artificial Sequence: Synthetic polypeptide
MIVRYVVSAVLIIGLSILAAVEQGCAEITVGSIKVFSGEYDDDSIGTKWAVLVAGSRGCWNYRHQADVCHAYQLLKKGGLKDENIIVFMYDDIAHNPENPRPGVIINSPNGHDVYKGVPKDYTGHHVTANNVLAVILGNKSALSGGSGKVVESGPNDHIFIFYSDHGGPGVLGMPSGPYLYADDLIDALKRKHASGTYKRLVFYIEACESGSIFEGLLPEGLNICATTASNAEEDSWGTYCPGDYPGPPPEYQTCLGDLYAVSWMEDSEKHNLQRETLGMQYELVKRRTANSFPYASSHVMQYGDLKLMDDPLSLYMGTNPANDNYTFLDENSSLLSAKPVNQRDADLLHFWDKFLKAPQGSIRKIEAQKQLTEAMSHRMHIDDSIALVGKLLFGIEKGPEVLIRVRPTGEPLVDDWDCLKSFVRTFETHCGSLSQYGMKHMRAVANICNSGIKMEQIAKASAQACVSIPSNSWSSLDEGFSA

SEQ ID NO: 182 - protein, 157 aa, Artificial Sequence
  Description of Artificial Sequence: Synthetic polypeptide
MSYGDQSQTIGDLAFEKFTFPSIFGNNVNILDVVFGCGHDNSGTFNNYTSVIIGLGGGEVSIVNQLDKEINGKFSYCLITIPLQSSISNATSHINFDADLELSPSSTFAEVEEDLVSLTIVPAEEVAIFGNLEQANFLIGYDLVANKISSLPTDCTS

SEQ ID NO: 183 - protein, 288 aa, Artificial Sequence
  Description of Artificial Sequence: Synthetic polypeptide
MINSRHRRKYGSKDEWNMRFGIYQSNVQFIDFFNSLNLSYNLTDNAFADMTNLEFNSKYLGYKKRKHSKQLAAPNITCDSSKLPISVDWRKSGVVTRVKDQENCGSCWAFSAVAAVEGINKIKTGKLVSLSEQQLVDCDVFSDNQGCNGGFMEKAFAFINKNGGITTEKNYHYVGKDQKCNTTKAKQHAVTISGYEMVAKNEESLQAAFTKQPISVAIDASGYDFQLCAGGVYSVFFGNSLNHGVPLIGYGVDDGEKYWLVKNSWGTMWGEDGYIKIKRWSNDKKRNV

SEQ ID NO: 184 - protein, 706 aa, Artificial Sequence
  Description of Artificial Sequence: Synthetic polypeptide
MANSLLSSNFMGSQIFVSPPTPKTTKYFHFHSKRKSLIPQSILNKKPNSDNSKNIPSKAALAALLFSSITPHAYALDNTTPTVPTPQVIQAEAANPTTSNPFSQNIILNAPKPQAQTNPELPEVSQWRYSEFLNAVKKGKVERVRFSKDGTTLQLNAVDGRRASVIVPNDPDLIDILAMNGVDISVSEGDSGGNGLFNLIGSLFPFIAFAGLFYLFQRSQGGPGGPGGLGGPMDFGRSKSKFQEVPETGVSFADVAGADQAKLELQEVVDFLKNPDKYTALGAKIPKGCLLVDHLVQERHFWLEQLLVKLVYHFSMCSIRVVELFVGVGASRVRDLFEKAKSKAPCIVFIDEIDAVGRQRGAGMGGGNDEREQTINQLLTEMDGFSGNSGVIVLAATNRPDVLDSALLRPGRFDRQVTVDRPDVAGRIKILQVHSRGKALAKDVDFEKIARRTPGFTGADLQNLMNEAAILAARRELKEISKDEISDALERIIAGPEKKNAVVSEEKKKLVAYHEAGHALVGALMPEYDPVAKISIIPRGQAGGLTFFAPSEERLESGLYSRSYLENQMAVALGGRVAEEVIFGQDNVTTGASNDFMQVSRVARQMVERLGFSKKIGQVAIGGGGGNPFLGQQMSTQKDYSMATADVVDAEVRELVERAYERATQIITTHIDILHKLAQLLIEKETVDGEEFMSLFIDGKAELYIS

SEQ ID NO: 185 - protein, 745 aa, Artificial Sequence
  Description of Artificial Sequence: Synthetic polypeptide
MIIEVLILWHADVRHNISLTALSSTQSFYKDDLYIVFLKDHPVNEESLFQRHIIVLSSLKGSDGAATESHVYSYTKIFNAFAAKLSQHEVHMLSSMDEVVSVIPNRYRKLHTTRSWEFIGLPATAKRRLKRESNIIVGVFDTGITPQSKSFKDDGLGPPPVKWKGSCGHFANFSGCNNKLIGARYFKLDKVPDPNDILSPIDVHGHGTHTSSTLAGSMVPDASLFGLARGTARGAVPSARVAMYKVCWVTSGCADIDILAAFEAAISDGVDLISISIGGLSGSYTTDVIAIGSFHAMRKGILTVASAGNDGPNLNTVANHAPWMLTVAASGIDREFRSKVALGNGRIVSGIGVSAFDPKKKLYPLTAGVDMAKSSDTRDSSRYCGEGSMDPRKVKGKLVYCQLGTWGADSVIKELGGIGTIIESDQFLDSAPIFMALATIVNSSIGKNINNYMHSERLPSAVIYKSQEVKIKAPFIASFSSRGPNPGTIRLLKPDIAAPGIDILASYTPLKSLTGLKGDTQYSEFTLMSGTSMSCPHVGGAAAYVKSYHPDWSPSAIKSALVTTARPMSSKVDREAEFAYGAGQVNPTKARSPGLIYDMDDMSYIQFLCHEGYNSSSVSSLLRQRVNCSTLIPANGEDAINYPTMQLGLKSNQEPTIGIFRRKVTNVGQAISVYNATIRAPKGVDITVKPTTLSFTRAMQTRSFKVVVKAKPMSNAVILSGSLIWKSSRHLVRSPIVIYDPKVFD

SEQ ID NO: 186 - DNA, 2372 bp, Artificial Sequence
  Description of Artificial Sequence: Synthetic polynucleotide
atggattccttaccagtctcctccattgaatctctagtcattgagatcaagaaagagatgttctcaaaccaagaatttaacacttttgtcaccccaatatctgcctatgacactgcttggttggccatgatttcttataataatcaagaagaagccattaatggtcattctttttctggccctatgtttaagagttgtttaaattggattctcaacaaccaaaatgagcaaggattttggggagaatccaatggtgtttgaaatttattcatgctaatacggaaatacttctgaaagagaattctcaacaatttccacgttggttcatcattgttttccctgcaatggttcaactttctaaatcagtaggcctggagattatttttgtgaatggatcagaaagattactttcggacgttgcaatgaaaaggaaagtaattcttgaaagtgaaaagctaatggacgtgacagcagggcatgatcaacctctattggcatatttagagagcttgccaaattatgttttgaatcaaaaagaccaaatcctaaaacatttaagtgaagatggttctttgtttcaatctccctctgctacagcacaagcattcatggccacaggaaaccaaaaatctcttgaatatctcatgtccattgttcataagtgtccaaatggagtgcagtaccttcaatgtttccagtggatgaagagctaacaaagctttgcatagttgaccacattcaaagaatggattgtttatctgagagattatacaaggactcattggcttttcgacttctccgtttgcaaggctataaaataaatgaagggaagtttttgttggtttgttcatcaaccgcagataagggcctacatagaaaagaatcaagaacgttttacgtatgtgatgtacaatgtgtacagagctacagatctcatgtttaaaggagaatctgaaatggaggaagtacgatcttttgccagatattttcttgaacgttcaatgaagctcgtgaacaatgagggcagcttattacttcttcctacacttcaaaaagtgattaagcatgagttgaatgttccatgggttgctcgactagaacatcttgatcacagattatggattgaattaagtcaatctctccctctttcaattggaaaatccgcagattattggttgtcttgtctgcacaatgacaaattgctgaaattagcagtgcaaaattacgaatttcggcagtcagtttacaggacggaattggaagaactaaagagagttggtcgaaagagaaaggccttgtggacattggatttgggcgagagaaaactacatattcctattttgcaagtgcagctagcagcagcagttttctaccttttgattcttattatgatgaggaagcttctttaagtgacttgcaaatcttaaccgacgctgtacaaaggttacataggtgggatggaagtaaccttgatggccctagtaagatcatatttgatgcacttgatgatcttgtgtgtgatgttgctaagttataccaccttcgacacgcaattgacatcaccccagaacttcgacatgtggcaggagacatttcttgcatggatgatggaaagtacgtggagtaataatgtagccatgccatctaggaatcaatacctagaaattggcatgatatcaatcggtgcacatattttggttcttcacgctgcttctcttgaaaatccaagcttgccaagggaaaaacttaggccaattaatggccaatatgaaaatattacaaagttgctaatggccaccactcgtttgttgaatgacatccagagctatcaacagaaagaatgtgaagtagggaaaatgaactacacattacttcacatgaatgaaaatccaggggcacaacttgatggttcaattgaatttgtgaaagagattttggccaacaagaagaaagaatttcttgaaaatgttctaatggatggattcaatgatatgccaaagaaatgcaaacttcttcatctttcttgcctaaatgtatttcacatgttcttcaattcttgcaatttatttgataccaaagcagcaattcttgaagatataatgagagctatttacgttcctcttcaagaacaaacctcagttccacctttaaaaacttctccaattttaacacctcaagaaaagaagaagaagaagaagaagaagattgagaatattccaactaaagtttctgcttgtctcaatgggaaaaacttcaaacaccaagttggcattggcataagttttgttggaagtaaagctcctaagaataatccttttggttggtatacaaaaggatttgcttcacaaaagttaagttcatgtttcatatga

SEQ ID NO: 187 - protein, 86 aa, Artificial Sequence
  Description of Artificial Sequence: Synthetic polypeptide
MDSLPVSSIESLVIEIKKEMFSNQEFNTFVTPISAYDTAWLAMISYNNQEEAINGHSFSGPMFKSCLNWILNNQNEQGFWGESNGV

SEQ ID NO: 188 - DNA, 1029 bp, Artificial Sequence
  Description of Artificial Sequence: Synthetic polynucleotide
atgggggggggtggttctagtggaaatacttcttcatgtttaatgggttatggagatgacaacaacaacaataacagtggaaatgcagccctatgtcctcctcctatgatgatgcctcctcctcctattaataataacaatggagaaagcagcaataatattggtggcaacaacaacaacaatatcctgtttctcccttttatggccaacaacaacaataatccacatgaagacgcaaactgttcttcttctagttccatcaagtctaagattatggctcatcctcactaccctcgtctcttgtctgcttatgtcaattgtcaaaagataggagctccgccggaagtggtggcaaggctagaggaagtatgtgccacgtcagcaacaataggccgtaacagtggcggcattatcggagaagatccagcgctagatcagttcatggaagcttactgtgaaatgctgacaaaatatgagcaagaactttcaaaaccctttaaggaagccatggttttcctctcaagaattgagtgccagtttaaagctctcactcttacttcctcctctgaatctgttgcagctctaggtgaggcaatcgatagaaatggatcgtctgaagaggaggttgatgtgaataacggtttcatcgaccctcaggctgaagatcaagaactgaaaggtcaattgctgcgcaaatacagtggttacttgggtagccttaagcaggagttcatgaagaagaggaagaaaggcaagctgcctaaggaagcaaggcaacaactactggactggtggaccagacattacaaatggccatatccatcggaatcccagaagctggcactggctgaatctacaggattggaccaaaaacaaataaacaactggtttatcaaccaaaggaaaaggcactggaaaccttcagaggatatgcagtttgtggtaatggatgctgctcatccacattactatatggacaatgttctcggtaatccttttccaatggatattacaccaactctcctctaa

SEQ ID NO: 189 - protein, 342 aa, Artificial Sequence
  Description of Artificial Sequence: Synthetic polypeptide
MGGGGSSGNTSSCLMGYGDDNNNNNSGNAALCPPPMMMPPPPINNNNGESSNNIGGNNNNNILFLPFMANNNNNPHEDANCSSSSSIKSKIMAHPHYPRLLSAYVNCQKIGAPPEVVARLEEVCATSATIGRNSGGIIGEDPALDQFMEAYCEMLTKYEQELSKPFKEAMVFLSRIECQFKALTLTSSSESVAALGEAIDRNGSSEEEVDVNNGFIDPQAEDQELKGQLLRKYSGYLGSLKQEFMKKRKKGKLPKEARQQLLDWWTRHYKWPYPSESQKLALAESTGLDQKQINNWFINQRKRHWKPSEDMQFVVMDAAHPHYYMDNVLGNPFPMDITPTLL

SEQ ID NO: 190 - DNA, 738 bp, Artificial Sequence
  Description of Artificial Sequence: Synthetic polynucleotide
atgtataccccagacactccggcgcaagaactatatgacgaggaatattacgacgagcagtcgccggagaagaagcgccgtctcactcccgagcaggtgcacttgctggagaagagctttgaggcggagaacaagctggagccagagcgtaagactcagctagccaagaagcttggcctgcagcccaggcaagtggctgtgtggttccaaaaccgccgcgcccggtggaagaccaagacgctcgaaagggattatgatcagctcaaatcctcttatgactctcttctctctgattttgactccattcgcaaagataatgagaagctcaaagctgaggtggtttcattgatggagaagttgcaggggaaagtggttggtgaagcaggggtaataaatgaaaaatgtgaggttttggaggtagatgcgctgacccttcaagtgaaggtgaaggcggaggacaggctgagcagtggcagcggcggaagtgcggtggtagatgagcacagtccacagctggtggacagtggggactcctattttcacactggtcatatggaagagtatccactaggggctggaggatgtaataatattcctccgcctatggatggtttgcagtcggaggaagatgatggtagtgatgacggcggcggccatggctacttctgtaacgtctttgtggcggcagaggagcagcaacatgaagaaggagagcctattgggtggttctggtcttga

SEQ ID NO: 191 - protein, 245 aa, Artificial Sequence
  Description of Artificial Sequence: Synthetic polypeptide
MYTPDTPAQELYDEEYYDEQSPEKKRRLTPEQVHLLEKSFEAENKLEPERKTQLAKKLGLQPRQVAVWFQNRRARWKTKTLERDYDQLKSSYDSLLSDFDSIRKDNEKLKAEVVSLMEKLQGKVVGEAGVINEKCEVLEVDALTLQVKVKAEDRLSSGSGGSAVVDEHSPQLVDSGDSYFHTGHMEEYPLGAGGCNNIPPPMDGLQSEEDDGSDDGGGHGYFCNVFVAAEEQQHEEGEPIGWFWS

SEQ ID NO: 192 - DNA, 1641 bp, Artificial Sequence
  Description of Artificial Sequence: Synthetic polynucleotide
acacattaaactaaagaagagagaactttagaggttagagagatgaagacgcaacatcaatggtgggaagttcttgatccattcttgacacaacacgaagctcttattgcattcttgacttttgcagcggttgtaattgtgatttacttgtaccgaccctcctggtccgtatgcaatgttcccggtccaaccgctatgcctctagttggtcacttgcccttgatggctaagtatggtcctgatgtcttctccgttcttgctaagcaatatggccctattttcagatttcagatggggaggcaaccactgataataatagcagaagcagagctttgcagagaagttgggataaagaagttcaaagatcttccaaacagaagcattccttccccaatctcagcttctcctcttcacaagaaaggcctcttcttcaccagggacaagagatggtctaaaatgagaaacaccatcctatctctctatcagccttcacatttaacaagtcttatccctacaatgcatagtttcatcacttctgctactcataatcttgattctaaaccgcgagatatcgttttctccaacctcttcctcaaacttaccactgatatcatcggacaagcggcttttggagtcgacttcggtctttccgggaagaaaccaatcaaagatgtggaggtgactgatttcataaaccagcatgtctactctacaacacaactcaagatggatttatcaggatcactctctatcatcttaggcttactgattccgattcttcaagagccgtttaggcaggtgttgaagaggataccgggaacaatggactggagagtcgagaagactaatgcaagactgagtggacaacttaatgagattgtgtcaaagcgagccaaggaggctgagactgactcaaaagacttcttgtcattgattttgaaagctcgagagtccgatcctttcgccaaaaacatcttcacatcggattatattagtgctgtgacttatgagcatcttcttcttgatgttgagaaacgtctgcttcaagaaattgacgggtttgggaaccgtgatctgatcccgactgctcatgacttacaacacaagtttccatacctcgatcaggtcattaaagaggctatgagattctacatggtttctcctttggttgcaagggaaactgctaaagaagtggagataggaggttatttactcccaaaggggacatgggtttggttagcactaggagttctagcaaaggaccctaaaaactttccagaaccggagaagttcaagccggaaagatttgatccgaacggagaagaggagaaacatagacatccatacgctttcatcccattcggtatcggtccacgagcctgtgttggacagagatttgccctgcaagagatcaaactcacattactgcatctctaccgtaattacattttcagacattccctagaaatggagataccactgcagcttgattatggtataattctcagcttcaagaacggggttaagctcagaaccatcaaaagattctgattcttgaaacaagtgaaataaaagcaagactgaaatttatatttaaattcaaaactccaatgtagttccaaaggaaaaagaacaattaac

SEQ ID NO: 193 - protein, 522 aa, Artificial Sequence
  Description of Artificial Sequence: Synthetic polypeptide
MKTQHQWWEVLDPFLTQHEALIAFLTFAAVVIVIYLYRPSWSVCNVPGPTAMPLVGHLPLMAKYGPDVFSVLAKQYGPIFRFQMGRQPLIIIAEAELCREVGIKKFKDLPNRSIPSPISASPLHKKGLFFTRDKRWSKMRNTILSLYQPSHLTSLIPTMHSFITSATHNLDSKPRDIVFSNLFLKLTTDIIGQAAFGVDFGLSGKKPIKDVEVTDFINQHVYSTTQLKMDLSGSLSIILGLLIPILQEPFRQVLKRIPGTMDWRVEKTNARLSGQLNEIVSKRAKEAETDSKDFLSLILKARESDPFAKNIFTSDYISAVTYEHLLAGSATTAFTLSSVLYLVSGHLDVEKRLLQEIDGFGNRDLIPTAHDLQHKFPYLDQVIKEAMRFYMVSPLVARETAKEVEIGGYLLPKGTWVWLALGVLAKDPKNFPEPEKFKPERFDPNGEEEKHRHPYAFIPFGIGPRACVGQRFALQEIKLTLLHLYRNYIFRHSLEMEIPLQLDYGIILSFKNGVKLRTIKRF

SEQ ID NO: 194 - DNA, 2329 bp, Artificial Sequence
  Description of Artificial Sequence: Synthetic polynucleotide
atctcctctcttgtagatttgccgcttctcatggcttccactactctctccgacctccctgacgtcatcttatccaccatttcctctctcgtatccgattcccgagctcgcaactctctctccctcgtctctcacaaattcctcgctctcgaacgatccactcgctctcacctcactatccgtggcaacgctcgtgatctctccctcgtccccgactgtttccgatcaatctcacatctcgatctctctttcctctccccatggggtcacactcttctcgcttctctcccaatcgatcaccagaaccttctcgctctccgtctcaaattctgtttccctttcgtcgagtctctaaacgtctacacacgatctccgagctctctcgagcttctacttcctcaatggccgagaattcgccacatcaagctcctccgatggcatcaacgagcttctcagatccctaccggtggcgattttgttcctatttttgaacactgtggtggtttccttgagtctttagatctctccaacttctatcactggactgaagacttacctcctgtgcttctccgctatgctgacgtggcggcgaggcttacacggttagatctcttgacggcgtcgttcaccgagggatacaaatcaagcgaaatcgttagtatcaccaaatcttgccctaatttgaagacttttcgtgtagcttgtacgtttgatccgagatactttgaattcgtcggagacgagactctctccgccgtagctaccagttcccctaagttaacgcttctacacatggtggacacagcttcgttggcgaatcctagagctattccaggtacggaagctggagattcagctgtcacggcggggacgctaattgaagttttctcaggtttaccgaatctagaggagctggttcttgacgtaggaaaggatgtgaagcatagtggtgtagctttagaggcattgaattctaaatgcaagaagttaagagtattgaagctaggacagttccaaggtgtttgctctgctacagaatggaggaggctcgacggtgtggctttatgtggaggattgcagtcgttgtcgattaagaattccggcgatttgactgatatgggtttggtggctatagggagaggatgttgtaagttgactacgtttgagattcaagggtgtgagaatgtaacagtggatggactaagaacaatggttagtcttcggagtaagactttgactgatgtgagaatctcttgctgcaagaatcttgacacagctgcttctttaaaggcaattgagccgatttgtgatcggatcaagagactgcatatagactgtgtgtggtctggttcagaggacgaggaggtagaaggaagagtggaaactagtgaggctgaccacgaagaggaggatgatggttacgagaggagccagaagaggtgcaagtattcattcgaggaagaacactgctcaactagtgatgtgaatggattctgttctgaagatagagtatgggagaaactggagtatctatctttatggatcaatgttggagaatttttgacgccattacctatgacaggactagatgactgtccgaatttggaagagattaggatcaagatagaaggagattgcagaggtaaacgcaggccagccgagccagagtttgggttaagttgtctcgctctctacccaaagctctcaaagatgcagttagattgcggggacacaatcggtttcgcactgaccgcaccgccaatgcagatggatttgagtttatgggaaagattcttcttgaccggaattggaagcttgagcttgagcgagcttgattattggccaccacaggatagagatgttaaccagaggagtctctcgcttcctggagcaggtctgttacaagagtgcctgactttgaggaagctgttcatccatggaacagctcatgagcatttcatgaactttttgttgagaatcccaaacttaagggatgtacagcttagagcagactattatccggcgccggagaacgatatgagcacagagatgagagttggttcgtgtagccgattcgaggaccaattgaacagccgcaacatcattgactgaaacttgaagagtgagttacctacactattatatctgtattgacttcagaaactggtccattttatttgtatggtcaagagtgttttgtatatgtttgtaagaggaaaggacaaagactataatttgcgatgattaatgatatcataaaacaataatccatttttataaatgataaaactcaaatgaagaagccggagagatctggagtacaaactca

SEQ ID NO: 195 - protein, 693 aa, Artificial Sequence
  Description of Artificial Sequence: Synthetic polypeptide
MASTTLSDLPDVILSTISSLVSDSRARNSLSLVSHKFLALERSTRSHLTIRGNARDLSLVPDCFRSISHLDLSFLSPWGHTLLASLPIDHQNLLALRLKFCFPFVESLNVYTRSPSSLELLLPQWPRIRHIKLLRWHQRASQIPTGGDFVPIFEHCGGFLESLDLSNFYHWTEDLPPVLLRYADVAARLTRLDLLTASFTEGYKSSEIVSITKSCPNLKTFRVACTFDPRYFEFVGDETLSAVATSSPKLTLLHMVDTASLANPRAIPGTEAGDSAVTAGTLIEVFSGLPNLEELVLDVGKDVKHSGVALEALNSKCKKLRVLKLGQFQGVCSATEWRRLDGVALCGGLQSLSIKNSGDLTDMGLVAIGRGCCKLTTFEIQGCENVTVDGLRTMVSLRSKTLTDVRISCCKNLDTAASLKAIEPICDRIKRLHIDCVWSGSEDEEVEGRVETSEADHEEEDDGYERSQKRCKYSFEEEHCSTSDVNGFCSEDRVWEKLEYLSLWINVGEFLTPLPMTGLDDCPNLEEIRIKIEGDCRGKRRPAEPEFGLSCLALYPKLSKMQLDCGDTIGFALTAPPMQMDLSLWERFFLTGIGSLSLSELDYWPPQDRDVNQRSLSLPGAGLLQECLTLRKLFIHGTAHEHFMNFLLRIPNLRDVQLRADYYPAPENDMSTEMRVGSCSRFEDQLNSRNIID

SEQ ID NO: 196 - DNA, 1110 bp, Artificial Sequence
  Description of Artificial Sequence: Synthetic polynucleotide
atgggcagacagccactagttatagtagcagatgcagagctatgcagagaagttggaataaagaaattcaaggacataccaaatagaagcatcccatctcccattgcagcatcccctcttcatcagaaaggcctattttttactagggactccagatggtcaacaatgagaaacactattctatcagtctaccagccatcttaccttgttaagttagtgccaatcatgcaatcgtttatcgagtcttcaactaaaaatcttgattctgagggagatctcacattctctgatctctccctcaagttagctactgatgtaattggacaagctgcttttgaaagaacaaacaagaatttaagcaggaggttagatgagatagtggcaaagaggatggaggaaaaagatcgcagttcaaaggacttcttatcgcttatactgcaggcaagggagtcagagaagttagctaagaatgttttcacctcagattatatcagtgctgtaacttatgagcacttactggctggttctgcaacaacttcctttacattgtcttctattatctatttggttgctggccatccagaggttgagcagaagttgctcacggagatagatgcttttgggcctaatgatcacatactcactgccattgagcttcagcagaaattcccataccttgatcaggtaatcaaagaagcaatgaggtgttatgtcgtctcacccttagttgccagagaaacatcagctgaggtggagatcggaggctataaacttcctaagggcacatgggtttggttggctcttggagttcttgctaaggattcaaagaacttccccgaaccagagaagtttagaccagagaggtttgatccaagctgtgaagaggaaaaacaaaggcatccttatgcaaatattccatttggaatagggccgcgagcatgcataggacagaagttctccatacaagaacttaaactctcactgattcacttatatcgcaagtacatttttcgacactctccccttatggaaaagccactggaacttgagtatggtatagtacttaactataagcatggagtcaaggtttgtgccatcaagcgtaaatga

SEQ ID NO: 197 - protein, 369 aa, Artificial Sequence
  Description of Artificial Sequence: Synthetic polypeptide
MGRQPLVIVADAELCREVGIKKFKDIPNRSIPSPIAASPLHQKGLFFTRDSRWSTMRNTILSVYQPSYLVKLVPIMQSFIESSTKNLDSEGDLTFSDLSLKLATDVIGQAAFERTNKNLSRRLDEIVAKRMEEKDRSSKDFLSLILQARESEKLAKNVFTSDYISAVTYEHLLAGSATTSFTLSSIIYLVAGHPEVEQKLLTEIDAFGPNDHILTAIELQQKFPYLDQVIKEAMRCYVVSPLVARETSAEVEIGGYKLPKGTWVWLALGVLAKDSKNFPEPEKFRPERFDPSCEEEKQRHPYANIPFGIGPRACIGQKFSIQELKLSLIHLYRKYIFRHSPLMEKPLELEYGIVLNYKHGVKVCAIKRK

SEQ ID NO: 198 - DNA, 2175 bp, Artificial Sequence
  Description of Artificial Sequence: Synthetic polynucleotide
atggctacagctacacaacttacttgttctaccattattaacgacctacctgatgtgatcctttctaacatcatcgccgcaatctccgacgtccgcagccgcaactccgccgccctcgtctgccggaaatgcctcgtcctcgaacgttccacgcgcgtctccctcacgctccgtggcaacgtccgtgacctcttcatgttacccacttgcttcagatccgtaactcaccttgacctctcccttatctctccttggggtcacccactcctctctccggtcgacggcgccggcgcagaagctgacccttccctcatcgcccaccttctccgccacgcgtttccttccgtcacttccctcgttgtctacacgcgccacccattcaccctccagcttttgcctcctctatggccccacctaaaggaaatcaagcttgtgcggtggcaccagcgtccccaattagctactggtgatgaatttaatatgctatttgagaattgcccacagcttaaatctctagatttgtcgactttttactgctggacggatgatattcctacagcacttgaatctcatcctatggttgcttctaatctcactagctttaatctcttgaattccagttttcctgaagggtttaagtctgatgagattaaggtaattacacaagcttgtcctaatttgaaagagtttaaggttgcttgtatgtttgatcctaggtacattggttttgttggtgatgaaggtttggtttctatagctacaaactgtaccaaattatcagtgcttcatttggcggacacatcagctttgtccaactctaggggtgatccaaatgatgaggggttcaccgaagaggatgcgaagattagtgttggaactttgattgaggtattttctggtcttccattacttgaagagcttgttttagatgtttgtaataatgttagagacacgggtcctgccttggagattttgaatagaaaatgtcccaaattgagatcgttgaagttggggcaattccacggtatttctgtgccaattgaatcgaagttggatggggttgctctttgtcaagggcttcaatctctgtcgataagtaatgtgggggacttgaatgatatgggtttgatagctattggtagagggtgttcgaggttagccaagtttgagattcgaggttgtaagaagataactatgaggggaatgaggacactagcttctttgcttagcagaactttggttgatgtcaagatatcttgctgcaagaatcttggagcctcttcttcattgaaagcattggaaccgatacaaagacggatacaaaagcttcacattgactgtgtgtgggacagcgttgaagaatttgagaatcttgatggtaatggatacgggtttgatcttaacaggaatgatggaggggaggcatcaagcaactttgcttgttccggggacacatttggatgcgaggaagatgcttacatgtttagacagaagaaaagatgcaagttctcctatgatattaatagtttgtatgaggatgtcaatggccatggcaatggatatagtggacgatcatgggataagctgcaatgcctctctctttggattggtgttggtgagcttttgactcctttaacaactgcaggtcttgaagactgtcctaacttagaggagatcaagattagggtggaaggagattgcaggctttggtcaaaaccttcggagcgggcatttggactgagcaccctactactctatcctaagctttccaagatgcatttggattgtggagataccataggttatgcacacactgcgccatcagggcagatggatttgagcttgtgggagaggttttatctgtttgggattggaaatttgagccttgccgaactagattactggccacctcaagatagggacgttaaccaaaggtgtctatccctaccagcagctgggctgctacaagaatgcatcacactcagaaaactgttcatccatggaacagcgcatgaacatttcatgatgttccttcttagaatcccaaacataagagatgtacaactgagagaggattactatccagcaccagagaatgacatgagtacagagatgagagcagactccttgagccgctttgaagctgccctaaacaggcgcccaatatccgattga

SEQ ID NO: 199 - protein, 724 aa, Artificial Sequence
  Description of Artificial Sequence: Synthetic polypeptide
MATATQLTCSTIINDLPDVILSNIIAAISDVRSRNSAALVCRKCLVLERSTRVSLTLRGNVRDLFMLPTCFRSVTHLDLSLISPWGHPLLSPVDGAGAEADPSLIAHLLRHAFPSVTSLVVYTRHPFTLQLLPPLWPHLKEIKLVRWHQRPQLATGDEFNMLFENCPQLKSLDLSTFYCWTDDIPTALESHPMVASNLTSFNLLNSSFPEGFKSDEIKVITQACPNLKEFKVACMFDPRYIGFVGDEGLVSIATNCTKLSVLHLADTSALSNSRGDPNDEGFTEEDAKISVGTLIEVFSGLPLLEELVLDVCNNVRDTGPALEILNRKCPKLRSLKLGQFHGISVPIESKLDGVALCQGLQSLSISNVGDLNDMGLIAIGRGCSRLAKFEIRGCKKITMRGMRTLASLLSRTLVDVKISCCKNLGASSSLKALEPIQRRIQKLHIDCVWDSVEEFENLDGNGYGFDLNRNDGGEASSNFACSGDTFGCEEDAYMFRQKKRCKFSYDINSLYEDVNGHGNGYSGRSWDKLQCLSLWIGVGELLTPLTTAGLEDCPNLEEIKIRVEGDCRLWSKPSERAFGLSTLLLYPKLSKMHLDCGDTIGYAHTAPSGQMDLSLWERFYLFGIGNLSLAELDYWPPQDRDVNQRCLSLPAAGLLQECITLRKLFIHGTAHEHFMMFLLRIPNIRDVQLREDYYPAPENDMSTEMRADSLSRFEAALNRRPISD

SEQ ID NO: 200 - DNA, 1338 bp, Artificial Sequence
  Description of Artificial Sequence: Synthetic polynucleotide
atgcttacttccttcaaatcctctagctcctcctccgaagatgccaccgctaccaccaccgagaatcctcctcctttgtgcatcgcctcctcctcggccgcaacctccgcctcacatcacctccgtcgtcttcttttcaccgctgcgaatttcgtctcccagtcaaacttcaccgccgctcaaaacttactctcaatcctctcccttaactcttctcctcacggcgactccaccgagcgacttgtacacctcttcactaaagccttgtccgtacgaatcaaccgtcagcaacaagatcagacggctgaaacggttgccacgtggacgacgaacgaaatgacgatgagtaactccacggtgttcacgagcagtgtatgcaaagaacagttcttgtttcgaaccaagaacaacaattctgacttcgagtcttgttactatctttggctaaaccaactaacgccgtttattcggttcggtcatttaacggcgaaccaagctatcctcgacgcgacggagacaaacgataacggagctctacatatacttgatttagatatatcacaaggacttcaatggcctccattgatgcaagccctagcagagaggtcatcaaaccctagcagtccacctccatctctccgcataaccggatgcggtcgagatgtaaccggattaaaccgaactggagaccggttaacccggttcgctgactctttaggtctccaattccagtttcacacgctagtgatcgtagaagaagatctcgccggacttttgctacagatccgattgttagctctctcagccgtacaaggagagaccattgccgtcaattgtgttcacttcctccacaaaatatttaacgacgatggagatatgatcggtcacttcttgtcagcgatcaagagcttaaactctagaatcgttacaatggcagagagagaagctaatcatggagatcactcgttcttgaatagattctctgaggcagtggatcattacatggcgatctttgattcgttggaagcgacgttgccgccaaatagccgagagagactaaccctagagcaacggtggttcggtaaggagattttggatgttgtggcggcggaagagacggagagaaagcaaagacatcggaggtttgagatttgggaagagatgatgaagaggtttggtttcgttaacgttcctattggaagctttgctttgtctcaagctaagcttcttcttagacttcattatccttcagaaggttataatcttcagttccttaacaattctttgtttcttggctggcaaaatcgtcccctcttctccgtttcgtcgtggaaatga

SEQ ID NO: 201 - protein, 445 aa, Artificial Sequence
  Description of Artificial Sequence: Synthetic polypeptide
MLTSFKSSSSSSEDATATTTENPPPLCIASSSAATSASHHLRRLLFTAANFVSQSNFTAAQNLLSILSLNSSPHGDSTERLVHLFTKALSVRINRQQQDQTAETVATWTTNEMTMSNSTVFTSSVCKEQFLFRTKNNNSDFESCYYLWLNQLTPFIRFGHLTANQAILDATETNDNGALHILDLDISQGLQWPPLMQALAERSSNPSSPPPSLRITGCGRDVTGLNRTGDRLTRFADSLGLQFQFHTLVIVEEDLAGLLLQIRLLALSAVQGETIAVNCVHFLHKIFNDDGDMIGHFLSAIKSLNSRIVTMAEREANHGDHSFLNRFSEAVDHYMAIFDSLEATLPPNSRERLTLEQRWFGKEILDVVAAEETERKQRHRRFEIWEEMMKRFGFVNVPIGSFALSQAKLLLRLHYPSEGYNLQFLNNSLFLGWQNRPLFSVSSWK

SEQ ID NO: 202 - DNA, 990 bp, Artificial Sequence
  Description of Artificial Sequence: Synthetic polynucleotide
atgggaagagctccgtgttgcgacaagacaaaagtgaagcgagggccttggtcgcctgaagaagactctaaacttagagattacattgaaaagtatggtaatggtggaaattggatctctttccccctcaaagccggtttgaggagatgtgggaagagttgtagactgaggtggctaaactatttgagaccaaacataaagcatggtgacttctctgaggaagaagacaggatcatttttagtctcttcgctgccataggaagcaggtggtcaataatagcagctcatctaccgggacgaacagacaacgacataaaaaactattggaacacaaagctaaggaagaaactcttgtcttcttcctctgattcatcatcatcagccatggcttctccttatctaaaccctatttctcaggatgtgaaaagaccaacctcaccaacaacaatcccatcttcttcttacaatccgtatgctgaaaaccctaatcaatacccaacaaaatccctcatctccagcatcaatggcttcgaagctggtgacaaacagataatttcctatattaaccctaattatcctcaagatctctatctctcggacagcaacaacaacacctcgaacgcaaatggtttcttgctcaaccacaatatgtgtgatcagtacaagaaccacaccagtttttcttcagacgtcaatgggataagatcagagattatgatgaagcaagaagagataatgatgatgatgatgatagaccaccacattgaccagaggacaaaagggtacaatggggaattcacacaagggtattataattactacaatgggcatggggatttgaagcaaatgattagtggaacaggcactaattctaacataaacatgggtggttcaggttcatcttctagttcgataagcaacctagctgagaacaaaagcagtggtagcctcctactagaatacaaatgcttgccctatttctactcctag

SEQ ID NO: 203 - protein, 329 aa, Artificial Sequence
  Description of Artificial Sequence: Synthetic polypeptide
MGRAPCCDKTKVKRGPWSPEEDSKLRDYIEKYGNGGNWISFPLKAGLRRCGKSCRLRWLNYLRPNIKHGDFSEEEDRIIFSLFAAIGSRWSIIAAHLPGRTDNDIKNYWNTKLRKKLLSSSSDSSSSAMASPYLNPISQDVKRPTSPTTIPSSSYNPYAENPNQYPTKSLISSINGFEAGDKQIISYINPNYPQDLYLSDSNNNTSNANGFLLNHNMCDQYKNHTSFSSDVNGIRSEIMMKQEEIMMMMMIDHHIDQRTKGYNGEFTQGYYNYYNGHGDLKQMISGTGTNSNINMGGSGSSSSSISNLAENKSSGSLLLEYKCLPYFYS

SEQ ID NO: 204 - DNA, 5000 bp, Artificial Sequence
  Description of Artificial Sequence: Synthetic polynucleotide
aagctagcaccatagatagtgggtgtcaccattttacagcaaataatatgcctcaattggtggagaaagggtctttaaagttgaagtgtttttctttttttctctttctttttcttggtaggtggtggggaaggggaaaatgaggggacaaaacacgaaaaatcaattttgatgtataatttacacaagactcaagctaagtgatagagttgataaaaggataacaataatatgggacacataaattcatgacgtctccgtttatcggatattttctcaaattgatgtaacatatgtttcaagaagttcaaataatgtgtatatagatttatttctataaaatattatttcgaattataaatcttcgactcaagaaaaaataaaaatgttagatatggcaaaggggatagcacttagacaattaggcaacctcatatttgttacaagtgggggtgagggttcaactttgcattatttagcatcactttgttatttattttttttatataaaatttatagaacaggagatgttaatataaggatgacaatccagattgacaaagttgtgatagtgatactactgtaacatcttattcaatcatgcaaagcatctcccattaatttgtccatcttttcgaatattacgaaaatcagacctactttttttacatataattttctctaatgacatcacaggaactactcctgagagaaatattctcactcaagtttgaaaacgactcttaaattatgataaagtgataactacaatgaccggctaactcttgcgtgcattatgagtgtatatagttatatgttatttactctcgtcgtaaatatcaagtgcgaataatatgtatgaaatttagagaaatgagagtaaattagtcgatgtttttaatttacgttgtgatttattcgttactttttgctttctctaaagtcaatttcagtagttcgtggagatacattagattaaattaatctaatctgttaaatactacacggtaaaaaataaaaaatatttaaaacgacataaaattttattatcaaaataagtaaatcacaaattgggggggggtttggctttttttttttttgtccgaaaattattatcatcggtatatataactatgcttcttatattatatttttttagtgaaaattctaattttcgtaggcatacatttaattaagataagtaaatatgatgaataagaacagattgataaacgtgatttaagaaaaataaagaaaggagaaatgaatagtagttccaatttataaaaaaaagtcaagtacttaggagttaaggttcgtgagtagatgggacatatcacggtggaaaaggtagaagaagcttcaaagatacaaaagaaaaagaggggttgagattctgtgttgtgattaatacaattcaatcaaagaaaaagatgtgtcattttggacatacaactctccctaaaataaaatgccaataaacacagtacttgtggacatcatccacccatccttttatgactcatcacacaaaaaaaacacttttttccttcttatttttgaagatattctatgaagtttgttgtaaacttaaacaaaataaatcaacaaaattgtcctatctctaaatagaggagtttttaaaagttaaaaatcaatagaatagatacatgaagtagtcgaaggagatttgacattttattatgtatatatataaaattattttaatcatatataaaaaatataattttctatcaaaaagtgaatcctttcatatttgtatctccgccctatctccaaatattaagctcacacatgaaaagagcgagagacgaatgtagcctattggctatgggttccctcactttcgatatgatgtgtataaaaaaattaattgaaatctcaataaatattagattttaacaataagttaaaaattcaaatcattaagtggggtcttgatttattttcttttgttttctttctcaaactgatgtttttattaaggatttattagaaaaatatttctatctctcggggtaggaattaaatttgctatgtgtatatcctaccttttgttaaatttagtttacagaattatcggttaaatatgttagatatgttattattgttgttacgtccgaatagacacccataggtgtagtgtagtcaaattaataaaaccatggaatacgatgggatatcaaagttgataatttttaactaaaaaaaaatgtcactagatgatttttttttctctcaattgtctaatcttgacagaaagatgtacctaatgaaataataaaagtgcaacaaaaaagaatagacaaatttccaaaaattgaatcttttgttggtactcgtcaacaagttattcttcatgtctaaatcctaaaaaaaatatctcctcgtgtaaagactggtatattgaaaatttaaaataaattaatacatctaaacgtatcatatcttctatataatataaaatttttagtgactcgtttcttacaattcaataatttagtataaataatttgtcgattgcgcggatgaaagaaaggggtggtggtggagatataaagtgtgatcgatagggtatcttgtatgtgattaatatagctaaacaaaaaggtgaaaggcaaaaacatatatgaatggtggtcctattccatatttaaatggattattaggatacgtcgatttcactttgcaaaataccctctatagattcatatattttcttttctcatcaacttttttttctatcatataactagccttactctggcttctcacgtttcacatgtctcaatgtttatttgttttttttccactcttgggcgtctaaagggtttagaaaaatttgacaatgtggaccacccaaagtttataaaattagaattaaacagtcatgaaggcatatacctaggagttccatttacatcttcacgtataaaatgtgtactttatattaattttatttatctcatgattcttattagagatgataaatgtaacattttttttttgtttttattaaattttagaagagataaccttcttgattaattctatgattttccttttttattacgaaactgaaacttaacaattaactgagacataacaaacatgaatgtagttcatatctaaattaacatcaaagccatcatatctaactcaactaagttagtcatggtactcttgtgattgacataaattttacaataaactttcttagctagaacggactcaccaacaaatataaaaccacagaaaaaattatatcgaactcaatactaaacaaagaagtatggaagactaaatatgttgatacgaggtaggcttattggtgattttacaagggcttatatagcaaaagttgatacaaacaaatgggctaaaaagtaaatggcccatttattttatttattttttccattatcaatacacagatttgcacttcgttagcggacaattttgggtaaattatgaaaattgggcctcttcacaatttagatcccgaccgtgtggatggatggacaaggaaattttaggtccagttccagttatattggggagataaaaggaaaaattacgtggttaagtaatatatatattagttaattagttattataataattattttagttaattattattcgcgattaacattagtgataattatgtaggctgagattttgagtttgtataatttgaaattttaagatataatttctataacttttatatagtacaattttataaaatattatttgtataattgataaaatttagatgtttgtgtttgtataaatttatattttagatttatcaaaatataactcaattattcaaactaaccataatacgtacgaattcactcacaaattatacaaacaatacaatttgaaccatagctgcaacccctaataatgcgagctacgactataaagtataattaaatttatttactataacggatatttgcaaaaattctccttaggcataaccaataatggcccctgaacgagttgctcgaaaaagctaattaaagatcattcatttttggaaaactatataaatcagaagactaaaatatagcttttagcttttcacttgaaataagttattttttatttaaataaattattttgataattattaaacactctaataaattaaaaagatgatttttaagtcagattgatcagcttttaagtccatctaaagatgctttaattacatcttattttttaaaaaaaattaattattaaaatttcaaagttttcattgctctcgaagacatttttttaaatgtccggtacattgtaataatatattatttaatggaaggaaagtatagaaggattttttaaaaaaaataattaagtgataaacttttttagaaattataatatgttgtatatttacgttaaatttcttaattttttaatttaacatttcccaaaaattttgtgttatccaaatgtccgaataacaaccaattaactgacactgaatttgtgaattttacgagacaaatgttcttgttaaaatttcatattaggtttcaactgtgagttatttttggaaatttaaattatgtgtgttgatcaaaatactttaaatatttttttttcattatatcatgaattttaaatagatatcatatatttttaaaagatttagatttaaattttactattaatatactaaaccgacatagccttaagttgaaaaaatatcaaattcatcgagggaaaacgaaaattgcaagtatatttggccaaacgaagcacctgtccatgaaatgccacgtaaaaattctaagcaaaaatactacaataagtgcatggaatgagacgagcacgtgtcaagttgaaagaagcacctgtccatgaaatgccacgtaactcacaccttcaaaacctctccattgctacaaatctccatatttttgttttttttttttaagaaaaagataaaagtactagca

SEQ ID NO: 205 - DNA, 2058 bp, Artificial Sequence
  Description of Artificial Sequence: Synthetic polynucleotide
atgtcggtgaaaaattgtatgtcgattcaatgttgcaaaatcttgttcaagtttctactgtttatgattattatcatcagtagcgtgtttatcgatgtaagagctaaaagagaaaatgaaggttgggaatggggtttaggtcctctgattaaaagagcagaaagaaaaacagttatttcaactgaaaatggtgaagtctcatcagtcacagtagctgatggaacaacctatcatcttcaattcatcacattggaacccaactccctcttccttcccgttgttctacatacagatatggttttttatgttcacactgggtcggggaagctaacttggatgaatgaaaatgaagagaaatcagtggatttaagaataggagatgtattcaggctgccttttggatctattttcttcttagagagtgacttagaccctatcagacacaaacttagactttattccatttttcccaattcaggccgagaatcactgagtgagccctactccagcatccgtaaaatggttcttggattcgacaagaaagtcctccaagcggcatttcatgtaccagaggatgtgatagaagaagtgttggctggaacagaagtaccagccatagtgcacggtgtgccaaagtcaactaagaagaagaagaacttatgggagatggaggctcagttcatgaagactgttttaggaaggggtagttatagtttctttgacaaccgaaggaataaaaagaagagttctcaattgttcaatgtattccaagagaaaccagattttgagaattgcaacgggtggagcacggtaataaacaggaagaaattgccggcgttaaagggctcgcaaattggtatttacgtagtgaacttaacgaaaggatcaatgatggggccacattggaatccaatggctactgaaattggaatagcaattcaaggagaaggaatggtgagggtagtttgctcaaagagtggaacagggtgtaaaaacatgaggtttaaagtggaagaaggggatgtatttgttgtgccaaggtttgatcctatggctcaaatggcattcaataacaattcatttgtgtttgtggggtttagcacaactacaaagaaacatcatcctcagtacttaacggggaaggcatcggtcctccgaacattggataggcagatattggaagcatctttcaatgtgggcaacacaacaatgcatcagattcttgaagcacagggtgattcagttatactggagtgtacatcttgtgctgaggaagagaagaggttgatggaggaagaaatgaggaaggaggaggaggaagcgaagaagaaagaggaggcaagaaaggctgaagaagagagaagagagaaagaagcagaggaagaaaggaagagacaagaggaagaagcaaggaaaagggaggaagaggaaataaggaggagacaggaagaagaggaagctaggagaagacaagaggaagaggaagaggaaagagagagacaggaagctagaaagaaacaagaagaggaagaagcagcacaaagagaggcagagcaagcaaggagagaagaggaagaagcagaaaaaagaaggcaggaggaggaagaatcaaggagagaggagaaagcaagaagaaggcaacaggaggaagcaaggaggagagaggaggaagaagcagcaaaaaggcaacatgaggaagaagcagagagagaggcagaggaagcaagaaggatagaggaggaagaagcacaaagagaggcagaagaagcaaggagaatacaacaggaggaagaagcagagagagcaaggagaagagaagaagaagcagaaacaagaaggaaggaggaggaggaggaagaatcaaggagacaagaggaggaatcaaggaggagtgaagaagaggcagcaagagaggcagagagggaaaggcaagaggaagctgaaagacaagaagaagctaggagacgggaggaagaaacagaagagaggcatcaacaagaagaaaccgaggaagaggagccaggccaacctgaaatgaacggatattcctcaaactag

SEQ ID NO: 206 - protein, 685 aa, Artificial Sequence
  Description of Artificial Sequence: Synthetic polypeptide
MSVKNCMSIQCCKILFKFLLFMIIIISSVFIDVRAKRENEGWEWGLGPLIKRAERKTVISTENGEVSSVTVADGTTYHLQFITLEPNSLFLPVVLHTDMVFYVHTGSGKLTWMNENEEKSVDLRIGDVFRLPFGSIFFLESDLDPIRHKLRLYSIFPNSGRESLSEPYSSIRKMVLGFDKKVLQAAFHVPEDVIEEVLAGTEVPAIVHGVPKSTKKKKNLWEMEAQFMKTVLGRGSYSFFDNRRNKKKSSQLFNVFQEKPDFENCNGWSTVINRKKLPALKGSQIGIYVVNLTKGSMMGPHWNPMATEIGIAIQGEGMVRVVCSKSGTGCKNMRFKVEEGDVFVVPRFDPMAQMAFNNNSFVFVGFSTTTKKHHPQYLTGKASVLRTLDRQILEASFNVGNTTMHQILEAQGDSVILECTSCAEEEKRLMEEEMRKEEEEAKKKEEARKAEEERREKEAEEERKRQEEEARKREEEEIRRRQEEEEARRRQEEEEEERERQEARKKQEEEEAAQREAEQARREEEEAEKRRQEEEESRREEKARRRQQEEARRREEEEAAKRQHEEEAEREAEEARRIEEEEAQREAEEARRIQQEEEAERARRREEEAETRRKEEEEEESRRQEEESRRSEEEAAREAERERQEEAERQEEARRREEETEERHQQEETEEEEPGQPEMNGYSSN

SEQ ID NO: 207 - DNA, 633 bp, Artificial Sequence
  Description of Artificial Sequence: Synthetic polynucleotide
atgggtgattctgacgtcggtgatcgtcttccccctccatcttcttccgacgaactctcgagctttctccgacagattctttcccgtactcctacagctcaaccttcttcaccaccgaagagtactaatgtttcctccgctgagaccttcttcccttccgtttccggcggagctgtttcttccgtcggttatggagtctctgaaactggccaagacaaatatgctttcgaacacaagagaagtggagctaaacagagaaattcgttgaagagaaacattgatgctcaattccacaacttgtctgaaaagaagaggaggagcaagatcaacgagaaaatgaaagctttgcagaaactcattcccaattccaacaagactgataaagcctcaatgcttgatgaagctatagaatatctgaagcagcttcaacttcaagtccagactttagccgttatgaatggtttaggcttaaaccctatgcgattaccacaggttccacctccaactcatacaaggatcaatgagaccttagagcaagacctgaacctagagactcttctcgctgctcctcactcgctggaaccagctaaaacaagtcaaggaatgtgcttttccacagccactctgctttga

SEQ ID NO: 208 - protein, 210 aa, Artificial Sequence
  Description of Artificial Sequence: Synthetic polypeptide
MGDSDVGDRLPPPSSSDELSSFLRQILSRTPTAQPSSPPKSTNVSSAETFFPSVSGGAVSSVGYGVSETGQDKYAFEHKRSGAKQRNSLKRNIDAQFHNLSEKKRRSKINEKMKALQKLIPNSNKTDKASMLDEAIEYLKQLQLQVQTLAVMNGLGLNPMRLPQVPPPTHTRINETLEQDLNLETLLAAPHSLEPAKTSQGMCFSTATLL

SEQ ID NO: 209 - DNA, 1047 bp, Artificial Sequence
  Description of Artificial Sequence: Synthetic polynucleotide
atggaaagtctcgcacacattcctcccggttatcgattccatccgaccgatgaagaactcgttgactattatctcaagaacaaagttgcattcccgggaatgcaagttgatgttatcaaagatgttgatctctacaaaatcgagccatgggacatccaagagttatgtggaagagggacaggagaagagagggaatggtatttctttagccacaaggacaagaaatatccaactgggacacgaaccaatagagcaacgggctccggattttggaaagcaacgggtcgagacaaggccatttactcaaagcaagagcttgttgggatgaggaagactcttgtcttttacaaaggtagggccccaaatggtcagaaatctgattggataatgcacgaataccgtcttgagaccgatgaaaatggaccgcctcatgaggaaggatgggtggtttgtcgcgctttcaagaagaagctaaccacgatgaactacaacaatccaagaacaatgatgggatcatcatcaggccaagaatctaactggttcacgcagcaaatggatgtggggaatggtaattactatcatcttcctgatctagagagtccgagaatgtttcaaggctcatcatcatcatcactatcatcattacatcagaatgatcaagacccttatggtgtcgtactcagcactattaacgcaaccccaactacaataatgcaacgagatgatggtcatgtgattaccaatgatgatgatcatatgatcatgatgaacacaagtactggtgatcatcatcaatcaggattactagtcaatgatgatcataatgatcaagtaatggattggcaaacgcttgacaagtttgttgcttctcagctaatcatgagccaagaagaggaagaagttaacaaagatccatcagataattcttcgaatgaaacatttcatcatctctctgaagagcaagctgcaacaatggtttcgatgaatgcttcttcctcttcttctccatgttccttctactcttgggctcaaaatacacacacgtaa

SEQ ID NO: 210 - protein, 348 aa, Artificial Sequence
  Description of Artificial Sequence: Synthetic polypeptide
MESLAHIPPGYRFHPTDEELVDYYLKNKVAFPGMQVDVIKDVDLYKIEPWDIQELCGRGTGEEREWYFFSHKDKKYPTGTRTNRATGSGFWKATGRDKAIYSKQELVGMRKTLVFYKGRAPNGQKSDWIMHEYRLETDENGPPHEEGWVVCRAFKKKLTTMNYNNPRTMMGSSSGQESNWFTQQMDVGNGNYYHLPDLESPRMFQGSSSSSLSSLHQNDQDPYGVVLSTINATPTTIMQRDDGHVITNDDDHMIMMNTSTGDHHQSGLLVNDDHNDQVMDWQTLDKFVASQLIMSQEEEEVNKDPSDNSSNETFHHLSEEQAATMVSMNASSSSSPCSFYSWAQNTHT

SEQ ID NO: 211 - DNA, 975 bp, Artificial Sequence
  Description of Artificial Sequence: Synthetic polynucleotide
atggataatataatgcaatcgtcaatgccaccgggattccgatttcatccgacagaggaagagcttgtgggttattacctagataggaagatcaattcaatgaagagtgctttagatgtcattgtagagattgatctctacaaaatggagccatgggatatacaagcgaggtgtaaactagggtatgaagagcaaaacgagtggtacttctttagtcataaggacaggaagtaccctaccgggactaggaccaaccgagccactgcggctgggttctggaaagccacgggtagagacaaggcggtactatcaaaaaacagtgtcatcggaatgcggaagacacttgtctactacaagggtcgagctcctaatggaagaaagtccgattggatcatgcacgaataccgtctccaaaactccgagcttgccccggttcaggaggaaggctgggtggtgtgtcgagcatttaggaagccaattccaaaccagaggccattagggtacgagccatggcagaaccagctctaccacgtcgaaagtagtaacaactactcatcttcagtgacaatgaacacgagtcatcatatcggtgcatcttcatcaagtcataaccttaatcaaatgctcatgagcaataaccactacaatcctaataatacatcctcatcgatgcatcaatatggcaacattgagctcccgcagttggacagcccgagcttgtcgcctagtttagggacgaataaagatcagaacgagagtttcgagcaagaagaagagaagagctttaactgtgtggattggagaacactagataccttgcttgagacacaagtcatacatccgcataaccctaatattcttatgttcgaaacgcagtcgtataatccggcgccaagcttcccttccatgcatcaaagctataatgaggtcgaagctaatattcatcattctcttggatgcttccctgactcgtaa

SEQ ID NO: 212 - protein, 324 aa, Artificial Sequence
  Description of Artificial Sequence: Synthetic polypeptide
MDNIMQSSMPPGFRFHPTEEELVGYYLDRKINSMKSALDVIVEIDLYKMEPWDIQARCKLGYEEQNEWYFFSHKDRKYPTGTRTNRATAAGFWKATGRDKAVLSKNSVIGMRKTLVYYKGRAPNGRKSDWIMHEYRLQNSELAPVQEEGWVVCRAFRKPIPNQRPLGYEPWQNQLYHVESSNNYSSSVTMNTSHHIGASSSSHNLNQMLMSNNHYNPNNTSSSMHQYGNIELPQLDSPSLSPSLGTNKDQNESFEQEEEKSFNCVDWRTLDTLLETQVIHPHNPNILMFETQSYNPAPSFPSMHQSYNEVEANIHHSLGCFPDS

SEQ ID NO: 213 - DNA, 2103 bp, Artificial Sequence
  Description of Artificial Sequence: Synthetic polynucleotide
atggaaaggatacctgaagttagagaatcaactaggcagtttcctataggggctaaggtggctcatactttctcaacctccaagaaggaggtcggtattagaggctttcgagattttgacttggctattccaatacaaacatggaaaggaaagacctcctatcaggaggaagaagacctgatggtcgatgctggtacaatcaagcgtagtgatgattcacttgaagatagtggctctacatcatttcatggggcgagtcatcctccggaacctgttgatacagacctaatgagaccagtgtatgtaccaattggtcaaaacaaagcagatgggaaatgtctggtgaaaaacgtatctttgaagggtcctttcttggacgatctttcaatccggatgccaaatgtgaaaccaagcccatcccttctttcaccggcagagagcttggttgaagagccaaatgatctaggtgtaatctcctctccatttacagttcctcgtccttctcaaaacacagaaaccagtctgcctcctgattccgaagagaaagaatgtatttgggatgcatcactgcctccaagcggaaatgtgagtccacttagtagcattgatagtactggtgttgtgagatctatgagtattgtcaacagttgcacaagcacgtacaggagtgatgtgcttatgagtgatggcatgcttagtgtggacagaaactatgagagcacgaaagggagcattcgaggggattcactcgaaagtggtaaaactagccttagcagagcaagtgacagtagtggacttagtgatgatagtaattggagtaacatcactggcagtgccaataagcctcacaaaggaaatgatcctagatggaaggctattctcgcaattcgggcacgtgatggtatattaggcatgagccactttaagttactcaaaagacttggttgtggagacattggaagtgtttatctttctgagcttagcgggactcgctgctattttgcaatgaaagtgatggataaggcatcacttgcaagcaggaagaaattgacgcgtgctcagacagaaagagaaatcctacagttattagaccatccattcttgccaacattgtacactcattttgagaccgatcgcttctcatgtttggtcatggaatattgtcctggaggagatctgcatactctacgacagcgacaacctgggaagcatttttcagaatatgctgcaaggttttatgcagcagaagttctattggcgcttgaatatctacatatgcttggtgtagtgtacagggatttaaaacctgaaaatgttcttgtgcgtgacgatggccacattatgctttcagattttgacctctccttgagatgtgcagtttcacctacgctcataaggatctcatctgatgatccttctaaacgaggagctgcattttgtgtgcagccagcctgtattgagcccacaactgtatgcatgcagccagcatgctttcttccacgtttatttcctcaaaagagcaagaaaaaaacacctaagcctcgagctgattctgggtttcaagctaattcaatgcctgagctagttgcggaacctacttcagcacggtcaatgtcatttgttgggactcatgaatatttggcccccgagattatcaagggagaaggccatggcagtgcagttgactggtggacatttggtattttccttcatgaactactctatggaaagacccctttcaagggatcaggaaacagggcaactcttttcaatgtagttggccaacaacttaaatttccagattctcctgcaaccagttatgccagccgtgatctgatacgtggcttgcttgttaaagagcctcaaaaccggcttggggtgaaacgaggagcaactgagatcaagcaacatcctttctttgaaggtgttaattgggctctaatacgttgcagtacaccacctgaagtgccaagacccgtggagccagactaccctgcgaagtacgggcaagtgaaccctgttggggttggcaataccagtaaaagagtggtaggggcagatgcaaagtctgggggtaaatatcttgactttgagttcttttag

SEQ ID NO: 214 - protein, 700 aa, Artificial Sequence
  Description of Artificial Sequence: Synthetic polypeptide
MERIPEVRESTRQFPIGAKVAHTFSTSKKEVGIRGFRDFDLAIPIQTWKGKTSYQEEEDLMVDAGTIKRSDDSLEDSGSTSFHGASHPPEPVDTDLMRPVYVPIGQNKADGKCLVKNVSLKGPFLDDLSIRMPNVKPSPSLLSPAESLVEEPNDLGVISSPFTVPRPSQNTETSLPPDSEEKECIWDASLPPSGNVSPLSSIDSTGVVRSMSIVNSCTSTYRSDVLMSDGMLSVDRNYESTKGSIRGDSLESGKTSLSRASDSSGLSDDSNWSNITGSANKPHKGNDPRWKAILAIRARDGILGMSHFKLLKRLGCGDIGSVYLSELSGTRCYFAMKVMDKASLASRKKLTRAQTEREILQLLDHPFLPTLYTHFETDRFSCLVMEYCPGGDLHTLRQRQPGKHFSEYAARFYAAEVLLALEYLHMLGVVYRDLKPENVLVRDDGHIMLSDFDLSLRCAVSPTLIRISSDDPSKRGAAFCVQPACIEPTTVCMQPACFLPRLFPQKSKKKTPKPRADSGFQANSMPELVAEPTSARSMSFVGTHEYLAPEIIKGEGHGSAVDWWTFGIFLHELLYGKTPFKGSGNRATLFNVVGQQLKFPDSPATSYASRDLIRGLLVKEPQNRLGVKRGATEIKQHPFFEGVNWALIRCSTPPEVPRPVEPDYPAKYGQVNPVGVGNTSKRVVGADAKSGGKYLDFEFF

SEQ ID NO: 215 - DNA, 1068 bp, Artificial Sequence
  Description of Artificial Sequence: Synthetic polynucleotide
atggctttttctgcaccatcactttccaaattctctcttttggttgccatttcagcatcagctctcctctgttgtgcttttgcccgtgatttctccattgttggatacacgccggagcatttgacaaacactgacaagcttctagagctcttcgagtcatggatgtcagaacacagcaaggcttacaaaagcgtggaggagaaggtgcacaggtttgaggttttcagagagaatctgatgcatatagaccagaggaacaatgagatcaacagttactggctcggtttgaacgagtttgcggatttgacccatgaagagttcaaaggaagatatctaggacttgcaaagccacaattctctagaaagagacagccctcagctaacttcaggtacagagatatcacggacttgcctaaatccgtagactggagaaagaaaggcgctgtggctcctgtcaaggaccagggtcaatgtggtagctgttgggcattttcaacagttgcagctgtcgaggggatcaaccagatcacaacagggaatctgagttcgctttcagagcaagaactcatagactgtgacacaactttcaacagtggctgcaatggaggtctcatggactacgcattccagtacataatttcgaccggtggtctccacaaagaagatgattacccttatctcatggaggaaggaatttgtcaagagcagaaagaggatgtggaacgtgtgacaatcagcggctacgaagatgtccctgaaaatgatgacgaaagcctggtgaaggctttagctcatcagccagtcagtgtggctattgaggcttcaggaagagacttccagttctacaaagggggagtgtttaatggtaaatgtggaacagacctagaccacggtgtggcagcggttggatatggttcatcaaagggatctgactatgttattgtcaagaactcatggggaccaagatggggagagaaagggtttattaggatgaagagaaacactggtaaaccagagggactctgtggaatcaacaagatggcctcatatcctaccaagaccaagtga

SEQ ID NO: 216 - protein, 355 aa, Artificial Sequence
  Description of Artificial Sequence: Synthetic polypeptide
MAFSAPSLSKFSLLVAISASALLCCAFARDFSIVGYTPEHLTNTDKLLELFESWMSEHSKAYKSVEEKVHRFEVFRENLMHIDQRNNEINSYWLGLNEFADLTHEEFKGRYLGLAKPQFSRKRQPSANFRYRDITDLPKSVDWRKKGAVAPVKDQGQCGSCWAFSTVAAVEGINQITTGNLSSLSEQELIDCDTTFNSGCNGGLMDYAFQYIISTGGLHKEDDYPYLMEEGICQEQKEDVERVTISGYEDVPENDDESLVKALAHQPVSVAIEASGRDFQFYKGGVFNGKCGTDLDHGVAAVGYGSSKGSDYVIVKNSWGPRWGEKGFIRMKRNTGKPEGLCGINKMASYPTKTK

SEQ ID NO: 217 - DNA, 1071 bp, Artificial Sequence
  Description of Artificial Sequence: Synthetic polynucleotide
atggctctttcttcaccttcaagaatcctctgttttgctcttgccttatccgctgcttctctctccctctctttcgcttcttcccacgattactccatcgttggatactcccccgaggatttggaatctcatgacaaactcatagaactcttcgaaaactggatctcaaattttgagaaagcttatgaaaccgttgaagagaagtttcttaggttcgaagttttcaaggataatctaaagcacatcgatgagactaacaagaaagggaaaagctactggctcgggctcaacgagtttgcggatttgagccatgaggagttcaagaaaatgtatttagggctcaagactgatatagtgagacgcgatgaagaaagatcttacgcagagttcgcttacagggacgtcgaagctgttcctaagtctgttgactggagaaagaaaggagctgtggcggaagttaagaaccagggctcttgtggaagttgttgggcgttttcgacagtagcagctgtcgaaggtataaacaagattgtgacaggaaacttgacaacattgtcagaacaagaactcatagactgtgacacgacctacaacaatggctgcaacggtggtctcatggactatgcctttgagtacattgttaagaacggaggtctacgcaaggaagaagattatccttactctatggaagaaggaacttgcgagatgcaaaaggatgaatctgaaacagtaaccattaatggacaccaagacgtacctactaatgatgagaagagtctcttgaaggcattggctcatcagcctctcagtgtcgccattgatgcatctggtagagagttccagttctatagcggcggcgtgtttgatgggcggtgcggggttgatcttgaccacggtgtggctgcggttgggtatggatcaagcaagggttcagattacatcattgtgaagaattcttggggaccaaaatggggagaaaaaggttacatcaggctgaagaggaacactgggaaaccagagggtctctgtggaatcaacaagatggcttctttccccaccaaaactaagtga

SEQ ID NO: 218 - protein, 356 aa, Artificial Sequence
  Description of Artificial Sequence: Synthetic polypeptide
MALSSPSRILCFALALSAASLSLSFASSHDYSIVGYSPEDLESHDKLIELFENWISNFEKAYETVEEKFLRFEVFKDNLKHIDETNKKGKSYWLGLNEFADLSHEEFKKMYLGLKTDIVRRDEERSYAEFAYRDVEAVPKSVDWRKKGAVAEVKNQGSCGSCWAFSTVAAVEGINKIVTGNLTTLSEQELIDCDTTYNNGCNGGLMDYAFEYIVKNGGLRKEEDYPYSMEEGTCEMQKDESETVTINGHQDVPTNDEKSLLKALAHQPLSVAIDASGREFQFYSGGVFDGRCGVDLDHGVAAVGYGSSKGSDYIIVKNSWGPKWGEKGYIRLKRNTGKPEGLCGINKMASFPTKTK

SEQ ID NO: 219 - DNA, 1257 bp, Artificial Sequence
  Description of Artificial Sequence: Synthetic polynucleotide
atgacgaaaaaggcggtgcttattgggatcaattacccaggaaccaaggcggagttacggggatgcgtcaacgatgttcgtcgtatgtacaaatgtctcgttgaacggtacggcttctccgaggagaacatcaccgttctcatcgacaccgatgaatcctctactcagcctactggcaagaacatccgccgcgcgcttgctgatctcgtcgaatctgccgattccggcgacgttcttgtcgttcattacagtggacacggtacgaggttgccggctgagactggtgaagacgatgacactggtttcgacgagtgtattgttccttgcgacatgaatctgattactgatgatgattttagagatcttgtggacaaggttcctccaggttgcagaatgacaatcatttcagactcttgtcacagtggtggcctaatcgacgaagccaaggagcagattggagagagcactaagaaagaagccgaggacgaagatgaatctgaagaatcttcttcaagattcgggtttaggaagttcttgcgcagcaaagtggaaggcgccatcgagtctcgagggtttcacattggagggaacaagaaggatgaagatgaggcggaagaaatcgagactaaggagattgagcttgaagacggagaaacgatccatgccaaagacaaatctcttcctctgcagaccttgattgatattctcaagcagcaaacagggaatgataatatcgaagttgggaaaatcaggccaagcctttttgatgcgtttggtgatgattcgagcccgaaagtgaagaagtttatgaaagtgatcttaggtaagcttcaggctggaaatggagaagaaggtggattaatgggaatgcttggcaaattggcttcagggtttcttgagggtaaactaaacgatgaagactatgtgaaacccgctatgcagacacacgttgggagtaaagaagaggtttatgctggtggatcaagaggttcggttccgcttccagacagcgggatactgatcagcggttgccaaaccgatcagacctctgctgatgcgactccagcggggaaaccaactgaggcttatggagcgatgagcaattcgatacagacgatattggaggagacagacggtgagatatcaaacagagaaatggttacaagggctaggaaggcattgaagaagcaagggtttactcagcagccaggtttgtattgccatgatggttatgccaacgctcctttcatctgttga

SEQ ID NO: 220 - protein, 418 aa, Artificial Sequence
  Description of Artificial Sequence: Synthetic polypeptide
MTKKAVLIGINYPGTKAELRGCVNDVRRMYKCLVERYGFSEENITVLIDTDESSTQPTGKNIRRALADLVESADSGDVLVVHYSGHGTRLPAETGEDDDTGFDECIVPCDMNLITDDDFRDLVDKVPPGCRMTIISDSCHSGGLIDEAKEQIGESTKKEAEDEDESEESSSRFGFRKFLRSKVEGAIESRGFHIGGNKKDEDEAEEIETKEIELEDGETIHAKDKSLPLQTLIDILKQQTGNDNIEVGKIRPSLFDAFGDDSSPKVKKFMKVILGKLQAGNGEEGGLMGMLGKLASGFLEGKLNDEDYVKPAMQTHVGSKEEVYAGGSRGSVPLPDSGILISGCQTDQTSADATPAGKPTEAYGAMSNSIQTILEETDGEISNREMVTRARKALKKQGFTQQPGLYCHDGYANAPFIC

SEQ ID NO: 221 - DNA, 2965 bp, Artificial Sequence
  Description of Artificial Sequence: Synthetic polynucleotide
gtgatcaattccagtgtgcacaccacttgtttgatgaattgtctctgtggagatttttttttagatgggaggttgtttctctgtttcattgccatgtgatcaagtagtgagtcagttctctcagttgttatgtgtcaggggaagttatattcacaatctctccaagaatctggcttctctgcagaaggccatgcgaatgctcaaggctcggcaatatgatgtgataagaaggttggaaacagaagagtttacagggcgtcaacaaaggctttcccaagttcaggtatggcttactagtgtcctaatcattcaaaaccagtttaatgatctgcttcgtagtaatgaagttgagcttcaaaggttgtgtctttgtggtttctgctccaaagatttgaaattgagctatcgttatgggaaaagagttatcatgatgttgaaggaagttgagagtctcagttctcaaggattctttgatgtggtttctgaggcaactccgtttgctgatgtggatgagatcccttttcaacccacaattgttggtcaggagataatgcttgaaaaggcatggaaccgtctcatggaagatggatccgggattttgggtctgtacggtatggggggagtaggcaaaacgacactactcacgaagatcaacaataagttttctaaaatagatgacagatttgatgttgtgatatgggttgttgtgtctagaagttcaacagtccgtaagatacaaagagacatagcagaaaaggtaggccttgggggaatggagtggagcgagaaaaacgataaccagatagccgttgacatccacaatgtccttaggagacgaaagtttgttttattgttggatgacatatgggagaaagtgaatttaaaagcggttggagtcccgtatccaagcaaagataacggatgcaaggtagcattcactactcgttctcgagatgtgtgtgggcgcatgggggttgatgatccgatggaagttagctgtctacaacccgaagaatcttgggatttgtttcaaatgaaggttgggaaaaatacactgggaagtcacccagacattcccggacttgctagaaaagtcgctaggaaatgtcgtggcctaccattagcactcaatgttatcggtgaagctatggcatgcaaaagaacagtacatgaatggtgtcatgccattgacgttttaacatcatctgccatagatttttcaggtatggaagatgaaattctccatgttttgaagtatagctatgataatttaaatggggagctgatgaaatcctgcttcctctattgctctctgtttcctgaagactatcttattgataaagaggggttggtagactactggataagtgagggattcataaatgaaaaagaaggcagagagaggaatattaaccaaggttatgagataattggtacccttgtccgtgcatgtttgttgttggaggaagaaaggaacaaatcaaacgtgaaaatgcatgatgtggttcgtgagatggctctatggatatcatccgatcttgggaagcaaaaggagaaatgtattgtgcgagctggtgttgggttacgtgaagtaccaaaagtcaaggattggaacactgtgagaaagatttctttgatgaataatgagattgaagagatatttgacagtcacgagtgtgctgcacttacaactctatttctccaaaagaacgacgtggtaaagatctcggctgaattctttcgatgtatgcctcatctggtggttttagatctatcagagaatcagagtcttaatgaattaccagaagaaatatcagagctggcctctttgagatatttcaacttgtcatatacatgtatacatcaactacccgttggtttatggacattgaaaaagctaatacatctgaatctcgaacacatgagcagtcttgggagtatattagggatatcaaatttgtggaatttgaggacattgggactacgagattccagactgttgctagatatgagtttagtgaaggagctgcagctcttagaacatctagaagttataaccctagatatatcatcaagtttggttgcagagccattgttatgctctcaaaggttggtggaatgtataaaagaggtagattttaagtaccttaaggaagaatcagtgagagtattgactttgccaaccatgggtaatctccgcaagctcgggataaaaagatgtggaatgagggagataaagatagagaggacaacttcatcatcgtctcggaacaaaagtcccacaactccatgcttctcaaacctctccagagtctttatagctaaatgccatggtcttaaggatttgacgtggcttttgtttgctcctaatcttacttttcttgaagttgggttctcaaaggaagtagaggatataattagtgaagagaaagctgaggagcattcagctacgattgttccttttaggaaattggagacactacacctgtttgaattacgcgggctcaagagaatctatgcaaaggctctgcattttccgtgtctgaaagttatccacgtagaaaaatgtgaaaagctgagaaagcttccattggattctaaaagtgggatcgcgggtgaagaacttgtcatatattatggagagagagaatggatagaaagggttgaatgggaggaccaagcaactcaactccgtttcttaccttcatccaggtggcggtggagagaaacataatgaacttcactttcttctacaaacttttgttgtcatggtctaaagacatttgccggtgtgtaaatctcttccttgtctcttcttgtttgcataaccgttctcatcgttcttttggttagtgatcattggatttgtacttatctctttctctaaacgatgagtgtttgtttcggcttcatagaaacattacacagagactcatgagaaaatgaataaaaacttgcaagttcc

SEQ ID NO: 222 - protein, 889 aa, Artificial Sequence
  Description of Artificial Sequence: Synthetic polypeptide
MGGCFSVSLPCDQVVSQFSQLLCVRGSYIHNLSKNLASLQKAMRMLKARQYDVIRRLETEEFTGRQQRLSQVQVWLTSVLIIQNQFNDLLRSNEVELQRLCLCGFCSKDLKLSYRYGKRVIMMLKEVESLSSQGFFDVVSEATPFADVDEIPFQPTIVGQEIMLEKAWNRLMEDGSGILGLYGMGGVGKTTLLTKINNKFSKIDDRFDVVIWVVVSRSSTVRKIQRDIAEKVGLGGMEWSEKNDNQIAVDIHNVLRRRKFVLLLDDIWEKVNLKAVGVPYPSKDNGCKVAFTTRSRDVCGRMGVDDPMEVSCLQPEESWDLFQMKVGKNTLGSHPDIPGLARKVARKCRGLPLALNVIGEAMACKRTVHEWCHAIDVLTSSAIDFSGMEDEILHVLKYSYDNLNGELMKSCFLYCSLFPEDYLIDKEGLVDYWISEGFINEKEGRERNINQGYEIIGTLVRACLLLEEERNKSNVKMHDVVREMALWISSDLGKQKEKCIVRAGVGLREVPKVKDWNTVRKISLMNNEIEEIFDSHECAALTTLFLQKNDVVKISAEFFRCMPHLVVLDLSENQSLNELPEEISELASLRYFNLSYTCIHQLPVGLWTLKKLIHLNLEHMSSLGSILGISNLWNLRTLGLRDSRLLLDMSLVKELQLLEHLEVITLDISSSLVAEPLLCSQRLVECIKEVDFKYLKEESVRVLTLPTMGNLRKLGIKRCGMREIKIERTTSSSSRNKSPTTPCFSNLSRVFIAKCHGLKDLTWLLFAPNLTFLEVGFSKEVEDIISEEKAEEHSATIVPFRKLETLHLFELRGLKRIYAKALHFPCLKVIHVEKCEKLRKLPLDSKSGIAGEELVIYYGEREWIERVEWEDQATQLRFLPSSRWRWRET

SEQ ID NO: 223 - DNA, 3435 bp, Artificial Sequence
  Description of Artificial Sequence: Synthetic polynucleotide
atggcatcttcttcttcttcttctagatggagctatgatgttttcttaagttttagaggcgaagatactcgaaaaacgtttacaagtcacttatacgaagtcttgaatgataagggaataaaaacctttcaagatgataaaaggctagagtacggcgcaaccatcccaggtgaactctgtaaagctatagaagagtctcaatttgccattgttgttttctcagagaattatgcaacatcaaggtggtgtttgaatgaactagtgaagatcatggaatgcaaaactcgatttaagcaaactgttataccgatattctatgatgtggatccatcacatgttcggaaccaaaaggagagctttgcaaaagcctttgaagaacatgaaacaaagtataaggatgatgttgagggaatacaaagatggaggattgctttaaatgaagcggccaatctcaaaggctcctgtgataatcgtgacaagactgatgcagactgtattcgacagattgttgaccaaatctcatccaaattatgcaagatttctttatcttatttgcaaaacattgttggaatagatactcatttagagaaaatagaatccttactagagataggaatcaatggtgttcggattatggggatctggggaatggggggagtcggtaaaacaacaatagcaagagctatatttgatactcttttaggaagaatggatagttcctatcaatttgatggtgcttgtttccttaaggatattaaagaaaacaaacgtggaatgcattctttgcaaaatgcccttctctctgaacttttaagggaaaaagctaattacaataatgaggaggatggaaagcaccaaatggctagtagacttcgttcgaagaaggtcctaattgtgcttgatgatatagataataaagatcattatttggagtatttagcaggtgatcttgattggtttggtaatggtagtagaattattataacaactagagacaagcatttgatagagaagaatgatataatatatgaggtgactgcactacccgatcatgaatccattcaattgttcaaacaacatgctttcggaaaagaagttccaaatgagaattttgagaagctttcattagaggtagtaaattatgctaaaggccttcctttagccctcaaagtgtggggttctttgctgcataacctacgattaactgaatggaaaagtgctatagagcacatgaaaaataactcttattctggaattattgataagctcaaaataagttatgatggattagagcccaaacaacaagagatgtttttagatatagcatgcttcttgcgaggggaagaaaaagattacatcctacaaatccttgagagttgtcatattggagctgaatacgggttacgtattttaattgacaaatctcttgtgttcatctctgaatataatcaggttcaaatgcatgacttaatacaggatatgggtaaatatatagtgaattttcaaaaagatcccggagaacgtagcagattatggctcgccaaggaagtcgaagaagtgatgagcaacaacacagggaccatggcaatggaagcaatttgggtttcttcttattctagtactctacgctttagcaatcaggccgtgaaaaatatgaaaaggcttagggtatttaacatggggaggtcgtcgacacattatgccatcgattatctgcccaacaacttgcgttgttttgtttgcactaactatccttgggagtcatttccatctacatttgaactcaaaatgcttgttcacctccaactccgacacaattctctgcgtcatttatggacagaaacaaagcatttgccgtctctacggaggatagatctcagctggtctaaaagattgacgcgaacaccagatttcacggggatgccaaatttggagtatgtgaatttgtatcaatgtagtaatcttgaagaagttcaccattccctgggatgttgcagcaaagtcattggtttatatttgaatgattgtaaaagccttaagaggtttccatgtgttaacgtggaatctcttgaatatctgggtctaagaagttgcgatagtttagagaaattgccagaaatctacgggagaatgaagccggagatacagattcacatgcaaggctctgggataagggaactaccatcatctatttttcagtacaaaactcatgttaccaagctattgttgtggaatatgaaaaaccttgtagctcttccaagcagcatatgtaggttgaaaagtttggttagtctgagtgtgtcgggttgctcaaaacttgaaagcttgccagaagagataggggatttagacaacttacgggtgtttgatgccagtgatactctaattttacgacctccgtcttccatcatacgcttgaacaaacttataatcttgatgtttcgaggcttcaaagatggagtgcactttgagttccctcctgtggctgaaggattacactcattggaatatctgaatctcagttactgcaatctaatagatggaggacttccggaagagattggatccttatcctctttgaaaaagttggatctcagtagaaataattttgagcatttgccttcaagtatagcccaacttggtgctcttcaatccttagacttaaaagattgccagaggcttacacagctaccagaacttcccccagaattaaatgaattgcatgtagattgtcatatggctctgaaatttatccattatttagtaacaaagagaaagaaactacatagagtgaaacttgatgatgcacacaatgatactatgtacaatttgtttgcatataccatgtttcagaatatctcttccatgaggcatgacatctctgcttcagattccttgtcactaacagtatttaccggtcaaccgtatcctgaaaagatcccgagttggttccaccatcagggttgggatagtagtgtatcagtcaatttgcctgaaaattggtatatacctgataaattcttgggatttgctgtatgttactctcgtagcttaattgacacaacagctcacttgattcccgtatgtgatgacaagatgtcgcgcatgacccagaaacttgccttatcagaatgtgatacagaatcatccaactattcagaatgggatatacattttttctttgtaccttttgctggcttatgggatacatctaaggcaaatggaaaaacaccaaatgattatgggattattaggctatctttttctggagaagagaagatgtatggacttcgtttgttgtataaagaaggaccagaggttaatgccttgttacaaatgagggaaaatagcaatgaaccaacagaacattccactgggataaggaggactcaatataacaacagaacttccttttatgagctcatcaatgggtga

SEQ ID NO: 224 - protein, 1144 aa, Artificial Sequence
  Description of Artificial Sequence: Synthetic polypeptide
MASSSSSSRWSYDVFLSFRGEDTRKTFTSHLYEVLNDKGIKTFQDDKRLEYGATIPGELCKAIEESQFAIVVFSENYATSRWCLNELVKIMECKTRFKQTVIPIFYDVDPSHVRNQKESFAKAFEEHETKYKDDVEGIQRWRIALNEAANLKGSCDNRDKTDADCIRQIVDQISSKLCKISLSYLQNIVGIDTHLEKIESLLEIGINGVRIMGIWGMGGVGKTTIARAIFDTLLGRMDSSYQFDGACFLKDIKENKRGMHSLQNALLSELLREKANYNNEEDGKHQMASRLRSKKVLIVLDDIDNKDHYLEYLAGDLDWFGNGSRIIITTRDKHLIEKNDIIYEVTALPDHESIQLFKQHAFGKEVPNENFEKLSLEVVNYAKGLPLALKVWGSLLHNLRLTEWKSAIEHMKNNSYSGIIDKLKISYDGLEPKQQEMFLDIACFLRGEEKDYILQILESCHIGAEYGLRILIDKSLVFISEYNQVQMHDLIQDMGKYIVNFQKDPGERSRLWLAKEVEEVMSNNTGTMAMEAIWVSSYSSTLRFSNQAVKNMKRLRVFNMGRSSTHYAIDYLPNNLRCFVCTNYPWESFPSTFELKMLVHLQLRHNSLRHLWTETKHLPSLRRIDLSWSKRLTRTPDFTGMPNLEYVNLYQCSNLEEVHHSLGCCSKVIGLYLNDCKSLKRFPCVNVESLEYLGLRSCDSLEKLPEIYGRMKPEIQIHMQGSGIRELPSSIFQYKTHVTKLLLWNMKNLVALPSSICRLKSLVSLSVSGCSKLESLPEEIGDLDNLRVFDASDTLILRPPSSIIRLNKLIILMFRGFKDGVHFEFPPVAEGLHSLEYLNLSYCNLIDGGLPEEIGSLSSLKKLDLSRNNFEHLPSSIAQLGALQSLDLKDCQRLTQLPELPPELNELHVDCHMALKFIHYLVTKRKKLHRVKLDDAHNDTMYNLFAYTMFQNISSMRHDISASDSLSLTVFTGQPYPEKIPSWFHHQGWDSSVSVNLPENWYIPDKFLGFAVCYSRSLIDTTAHLIPVCDDKMSRMTQKLALSECDTESSNYSEWDIHFFFVPFAGLWDTSKANGKTPNDYGIIRLSFSGEEKMYGLRLLYKEGPEVNALLQMRENSNEPTEHSTGIRRTQYNNRTSFYELING

SEQ ID NO: 225 - RNA, 20 nt, Artificial Sequence
  Description of Artificial Sequence: Synthetic oligonucleotide
uuggauugaagggagcucug

SEQ ID NO: 226 - DNA, 188 bp, Artificial Sequence
  Description of Artificial Sequence: Synthetic polynucleotide
gttttgagagtggagctccttgaagtccaacagaggatctaacaggtaagattgagctgctgacctatggattcctcagccctatctattatttgattggataggtttgtgggttgcatatgtcaggagcttcattgccctaagttggatccctttttggattgaagggagctctacattcatttgac

SEQ ID NO: 227 - RNA, 20 nt, Artificial Sequence
  Description of Artificial Sequence: Synthetic oligonucleotide
uuuggauugaagggagcucu

SEQ ID NO: 228 - DNA, 1107 bp, Artificial Sequence
  Description of Artificial Sequence: Synthetic polynucleotide
atggtggatgggcatgtatcagctggttcaagaaatgagaacggtacaacacccagaaataataatgtggaaatttcaatagcaacagcgtcatcaatgtttcctggtttcaggttttcaccaacggacgaagaactcatatcatattacttgaaaaagaaacttgaggggtctgataagtgtgttgaagttatttctgaggttgagatttggaaacatgaaccttgggatttaccagcaaaatccgtcattcaatcagataatgaatggttcttcttttctcctcgtggaaggaagtatccaaacgggtcgcaaagtaaaagggcaactgaatctggttactggaaggccacaggaaaagaacgtaatgtgaaatctggttcgaatctcattggcacaaagagaactctggtgttccacactggtcgagcacctaaaggacagaggacacattggataatgcatgaatattgcatgagcggaaacactaattatcaggattctatggttgtctgccgcctccggaagaatagtgagtttcatttgaatgacaccccaagaaatcaaaggaatcaactggctgctaccgctactgcaaccgctcagtctggagcaggacaattgggcagcttggaattggtcactgtaggggattgctgttgttcaaaggaagggagtagcagtttttattcccattcggttgagcagattgactctggatcagaatctgataaaccaactaaagagttctctcagcacgattcctctggccacttcaaggactgtgatggcgaggaggactggtttgctgatataatgaaagatgatatcattaagctagacgaatcttcgttgaatgcccaacctatttccatggttcccagtaggcctgaatcctcgatatcaactcatgaagctcgagctgcgatgtccggtgtggctcctttccagggcaccgctaatcgaagactcagactagtaagggaaaaagtagtggtgtgtccagtagagggatccagaatgtatgaagctaccaaaaagaataaaatcggagtgagcataactagttcaggaagatggctgagaaacatgttttcagttaaatga

SEQ ID NO: 229 - protein, 368 aa, Artificial Sequence
  Description of Artificial Sequence: Synthetic polypeptide
MVDGHVSAGSRNENGTTPRNNNVEISIATASSMFPGFRFSPTDEELISYYLKKKLEGSDKCVEVISEVEIWKHEPWDLPAKSVIQSDNEWFFFSPRGRKYPNGSQSKRATESGYWKATGKERNVKSGSNLIGTKRTLVFHTGRAPKGQRTHWIMHEYCMSGNTNYQDSMVVCRLRKNSEFHLNDTPRNQRNQLAATATATAQSGAGQLGSLELVTVGDCCCSKEGSSSFYSHSVEQIDSGSESDKPTKEFSQHDSSGHFKDCDGEEDWFADIMKDDIIKLDESSLNAQPISMVPSRPESSISTHEARAAMSGVAPFQGTANRRLRLVREKVVVCPVEGSRMYEATKKNKIGVSITSSGRWLRNMFSVK

SEQ ID NO: 230 - DNA, 3822 bp, Artificial Sequence
  Description of Artificial Sequence: Synthetic polynucleotide
atgtatcccatgtatgggttcatggacacacatccttaccaaagaaaccgagtacctcacaaccctccttattatccccagtttgaaccgaatcatcatcatctgaacattgatccagctagatctcctgtagcttatgaatcctggccttgtggtggtaactatgggcatccttatccaccgcagtgtcacagttgctgtatccataacaattccccgagccagtgtgcattcggtcctccttatccctaccttccactgcctccctacaacaactgtagcaatccagcatatccggtgatgtatgctgctaattatgtttctccccattttactatggagcagcctcggtacgaatatgataagaatatgggaagtggtcatcacttctgtggctgtccaaatcatccatgttatacgaaaggagggagcaacattaaaatagaagaacaggaccaggataagaaaaatgaaagcaatgagtccttggttccttttgggttcaagaattgtccttatcctgttctgtggatgccacctgattatatgatgaatagcgcacacgtgaagcctaatggatttgaaggtaaacgggatgaggtgaaagatgtgaaaccgtatggtgattgcagatctttcgaacaaccaaatatctggaatgtatggtctccttatcaagggaacaactcggaattaccaaagcaaaggggagatccacccagaaaacaacaccacgatgatatgaacaagaaacagtttccatttccaataatctggatgccttacaaacctgaggaaatagacggcaaagttagcaaggagactggtgttgatcaggagcagacctcccccttaaaatctaccataccaaagttacatgatgttgaagaggatagaagcgattctagagaaaatgtagtgaatagaggaagtgaaatccacggaaagggactgaataaagattctgttacgaaaatcattccagtaaggcaaatggagcaaattgaggatgtcttggatggaaaaccggaagatgcttccaaacagcatgatgttgatgctaaagagaagaaaaccactgaagacggtggcaagaagcagtcgtcttctcctacaaagtcatccaagctgccccctgtttgtctaagagttgatcccctgcctaggaaaaaaagcagtaacggcagttctaggtcccctagtcctcctggtgggaaacggaaattagtagattcgccaagtgacagctccaaacctcccatcttatcaaatgagaaggagaatgttcatcttgacaaatcatccacaacagctacgccggagaaaagcatagaagtggatccaagtgaaggaaaaagaaaagttgttaaggttgcccaagggactagcaaagaagataaacttcaagatcaatatacggttttccctgatctgaaagggaaggcaaggggccaaagcagtgagggtgatactagtaaagcaaccaatgagctcaagcatcaacctgatggagtagcagcagaacctcagtccaacaatcaaggacatcagattggtgaggccagagaagcagcgaagggaaatgcgggtttagttgtgtacatgaaaccagataggagtaagctgtctgatgataacgcggctactgtgattcagtcggcataccgagggttcaacgtgcggagatgggagcctctgaagaaattaaagcagataactaaaataaaggagcagatggctgagcttaaaaactgtattcaggctttggagagctcagctgacaacaaacagatgactattctcacagaagccataatgggtcttctgctgaagcttgacgctattcaggggttacatccaaccgttagggaatatagaaaatctgtagcaaaggagcttgttagcctgcaggagaagctggatcttctgaactgtaagaagcaactggcagaaagtgaacaggctttaactgctcaatccagcggggatgcatgcaggacggtggaagacaacatttccatgcagggaggccgagaggtgccaaagtttgaacaggatgatgatttagcgcggggagatgaagaaataaaggtacatgcaaaggagccctgtcaagagcagcctctttgtgcggcagagacactccccaactctcatcacgtaggcaatgcagaggaagtggtcggtaaagaagaaagtgagaacgttgaggaggtggtggagaacttttcaagtggtggtgcagtggtggatgaggcaacagaatcactttctgaatctaaagaaaatttgaatgataagtcacctgatgagaatacggtagtagttgagaaatcagaagagcatgacaaagctgaacaatctttgccaaatcctattccattttctgtagatctgacagaaaacttgggcttagaggtcagaggttgtggtttgaaggggaagggtggaggtgttgatgaattggaagagctcccgcaaggagtccttgatgaagagactagtgttcaagggtctactgagatcagaaaagacgaggtcctccaacatgacaatggaaaccttactgctcatattcctgaagaaaaagtctctgatacagagaggcgagagcaccaccacttggaagcattaggtgaaacactagttgttttggggccaatgaacatccacagcagcaatggacaaaaagaaaattcagaagttctggaaacagataaaacagtacgagttgatgctccagaacaggagaaagaagatctcagaccattaaatgaagatgggaagatctctgatgttgatgctaaggttggtatggaagaggatggcgaggaacgtggacaatgcagcactgggtcagacgcgtttccaatatactcacaggaagaagcaatcaccatgaagcagtctacagatgccaccaacatggaggaattggaaacaactggagttctgcaggagaaaatgcaaaatgcagtagagagagacattgaaatccttaattcaaaaaaaaccattgaagtgtcagcagaacctcaactatttactgctaccattgacgaggccaaagaatattatgctcaggataagcagaatgttggggaggaaaatatggaggtgcaaggtgaggaattgcctgctcgcagtgatgctttggtctctgtactcaagagtgaacacaaagagaataatgtggaggttgagcagaggcatctggaggaaaactttgagatgcaagaggaagaaccagtggctgctgataaccctgcacctatgaccgaggaaccagtggatgaaagtatagtgatgactgctccaaaatcagaagctgtaactactgagacgcagctgttaggggagaaagagcttggtgtagcagaggaccgcagcacatatccatcgacatgtgatactgtggaaggtaattcagctgatgctgtctgctcttttggttctacgcctaatgaagcacaagtaatggatgcaaaggagcttaaagaatggaagagagtggaaatgtcaccatcatcacctactgctagccaagtatcctttgatagtgatgcattctcagagagcagtcaaaagcttatagaagagaatgaaaaattaagggagatgatggagaaactaataaaagcagggaaagaacaactcactgttgtatccagtctttctggaagagttaaggacctggagaagagattgtccaggaagaagaagctgagattgagacgatatagggtaccaagagcaggttcagtctgtatgaagccattgaatgactcactgaaagacagagctgcggggttggcaatgtga

SEQ ID NO: 231 - protein, 1273 aa, Artificial Sequence
  Description of Artificial Sequence: Synthetic polypeptide
MYPMYGFMDTHPYQRNRVPHNPPYYPQFEPNHHHLNIDPARSPVAYESWPCGGNYGHPYPPQCHSCCIHNNSPSQCAFGPPYPYLPLPPYNNCSNPAYPVMYAANYVSPHFTMEQPRYEYDKNMGSGHHFCGCPNHPCYTKGGSNIKIEEQDQDKKNESNESLVPFGFKNCPYPVLWMPPDYMMNSAHVKPNGFEGKRDEVKDVKPYGDCRSFEQPNIWNVWSPYQGNNSELPKQRGDPPRKQHHDDMNKKQFPFPIIWMPYKPEEIDGKVSKETGVDQEQTSPLKSTIPKLHDVEEDRSDSRENVVNRGSEIHGKGLNKDSVTKIIPVRQMEQIEDVLDGKPEDASKQHDVDAKEKKTTEDGGKKQSSSPTKSSKLPPVCLRVDPLPRKKSSNGSSRSPSPPGGKRKLVDSPSDSSKPPILSNEKENVHLDKSSTTATPEKSIEVDPSEGKRKVVKVAQGTSKEDKLQDQYTVFPDLKGKARGQSSEGDTSKATNELKHQPDGVAAEPQSNNQGHQIGEAREAAKGNAGLVVYMKPDRSKLSDDNAATVIQSAYRGFNVRRWEPLKKLKQITKIKEQMAELKNCIQALESSADNKQMTILTEAIMGLLLKLDAIQGLHPTVREYRKSVAKELVSLQEKLDLLNCKKQLAESEQALTAQSSGDACRTVEDNISMQGGREVPKFEQDDDLARGDEEIKVHAKEPCQEQPLCAAETLPNSHHVGNAEEVVGKEESENVEEVVENFSSGGAVVDEATESLSESKENLNDKSPDENTVVVEKSEEHDKAEQSLPNPIPFSVDLTENLGLEVRGCGLKGKGGGVDELEELPQGVLDEETSVQGSTEIRKDEVLQHDNGNLTAHIPEEKVSDTERREHHHLEALGETLVVLGPMNIHSSNGQKENSEVLETDKTVRVDAPEQEKEDLRPLNEDGKISDVDAKVGMEEDGEERGQCSTGSDAFPIYSQEEAITMKQSTDATNMEELETTGVLQEKMQNAVERDIEILNSKKTIEVSAEPQLFTATIDEAKEYYAQDKQNVGEENMEVQGEELPARSDALVSVLKSEHKENNVEVEQRHLEENFEMQEEEPVAADNPAPMTEEPVDESIVMTAPKSEAVTTETQLLGEKELGVAEDRSTYPSTCDTVEGNSADAVCSFGSTPNEAQVMDAKELKEWKRVEMSPSSPTASQVSFDSDAFSESSQKLIEENEKLREMMEKLIKAGKEQLTVVSSLSGRVKDLEKRLSRKKKLRLRRYRVPRAGSVCMKPLNDSLKDRAAGLAM

SEQ ID NO: 232 - DNA, 1122 bp, Artificial Sequence
  Description of Artificial Sequence: Synthetic polynucleotide
atgcgacctcttcaaccacccccaccagccgccgccgccaccacctcctcctccaccaccgcatcacctatgccccctcctccttcacgcaaccgtccccgtcgtcgcaccgatttaactctcccccttccccaacgtgacccagctctcgccgtacccctccccctcccccctacttccgccccttcttcctcgtcgtcttcctcttcctccccactccccacccccttaaacttctccgaacttgagcgtatcaatcgcatcggcagcggcgctggcggtacggtttacaaagtcctacatcgccccaccggaagactctacgctctcaaagtcatctacggtaaccacgaggactccgttcgccttcagatgtgccgtgagatcgagattctccgtgacgtcgacaaccctaacgtcgttagatgtcacgatatgttcgatcacaacggtgaaatccaagtcctccttgaattcatggataaaggctctctcgaagggatccacatccctaaagagtcagctctttcggatctaacccgacaagtcctctcgggtctctattatctccacaggcgtaagattgtgcacagagatatcaagccctcgaatttactaatcaactcgaggcgcgaggtgaaaattgctgactttggggtgtcgagagtgctggcacaagatatggatccttgtaatgattcagttgggacaattgcctatatgagtccagagagaatcaacacagatctgaatcatggacagtacgatgggtatgctggagatatatggagtcttggtgttagcatattggagttttatttgggaaggtttccgttttctgttgggaggtcaggtgattgggctagtcttatgtgcgccatttgtatgtcgcagccgccggaggctccggcgaatgcttctagagagttcagggactttattgcttgctgtttgcagagggatcctgcacgacggtggacggcggtgcagctgttgcgtcatccatttattacccagaatagcccagccgccaccaccaccggtaatatgatgccacttcctaatcaggttcatcagccagcacatcaattgttacctccacctcctcatttttcttcttaa

SEQ ID NO: 233 - protein, 373 aa, Artificial Sequence
  Description of Artificial Sequence: Synthetic polypeptide
MRPLQPPPPAAAATTSSSTTASPMPPPPSRNRPRRRTDLTLPLPQRDPALAVPLPLPPTSAPSSSSSSSSSPLPTPLNFSELERINRIGSGAGGTVYKVLHRPTGRLYALKVIYGNHEDSVRLQMCREIEILRDVDNPNVVRCHDMFDHNGEIQVLLEFMDKGSLEGIHIPKESALSDLTRQVLSGLYYLHRRKIVHRDIKPSNLLINSRREVKIADFGVSRVLAQDMDPCNDSVGTIAYMSPERINTDLNHGQYDGYAGDIWSLGVSILEFYLGRFPFSVGRSGDWASLMCAICMSQPPEAPANASREFRDFIACCLQRDPARRWTAVQLLRHPFITQNSPAATTTGNMMPLPNQVHQPAHQLLPPPPHFSS

SEQ ID NO: 234 - DNA, 1245 bp, Artificial Sequence
  Description of Artificial Sequence: Synthetic polynucleotide
atggagtctcatcctcacaacaaaactgaccagacccagcatatcatcctcgtacacggtcccatcatcatcggagctggcccttctggtcttgccacttcagcatgtctctcgagccgtggagtcccttctttgatcctagaacggtcggattcaatagcatctctatggaaatctaaaacctacgaccgactcagactccatctcccaaaacacttttgccggttacccctcctggacttccctgaatattacccaaaatacccttccaaaaacgagttcttggcctaccttgagtcctacgcttcccacttccgcatcgctccaaggttcaacaagaacgtacaaaacgcagcttacgattcttcctccggtttctggagagtaaagactcatgataacacagagtacctctccaaatggcttatcgtagccaccggtgagaacgcagatccatacttccccgagattccagggagaaagaagttttccggcggaaaaatcgttcacgcgagtgagtacaaaagcggcgaagagttccggcggcagaaagttttggttgtcggatgtggaaattccggcatggaaattagcttagacctcgtccgacataacgcatctcctcatcttgttgtccggaacaccgttcatgtgttgccaagggagatacttggggtatcaacatttggagttggaatgacacttctcaaatgcttacccttaaggctcgttgacaagttcttgttattgatggccaatctttcgtttggaaataccgaccggttgggccttcgccgaccaaaaacgggtccgcttgagctgaaaaatgtcaccggcaaaagtccggttctcgatgtcggagctatgtctctcatcagatccggcatgattcagataatggaaggtgtaaaggaaataacaaagaaaggagcaaagtttatggatggtcaagaaaaggactttgactctatcatatttgccactggttacaaaagcaacgtgcctacttggcttcagggaggtgattttttcacggacgatgggatgccgaaaacgccgtttcctaacggctggagaggagggaaaggattgtacacagttggttttacgagaagaggactccttggaacggcgtctgacgccgttaagatcgctggcgaaattggtgaccagtggagagacgaaatcaaggggtccaccaggaatatgtgcagttctcgttttgtctttacctctaaatcctaa

SEQ ID NO: 235 - protein, 414 aa, Artificial Sequence
  Description of Artificial Sequence: Synthetic polypeptide
MESHPHNKTDQTQHIILVHGPIIIGAGPSGLATSACLSSRGVPSLILERSDSIASLWKSKTYDRLRLHLPKHFCRLPLLDFPEYYPKYPSKNEFLAYLESYASHFRIAPRFNKNVQNAAYDSSSGFWRVKTHDNTEYLSKWLIVATGENADPYFPEIPGRKKFSGGKIVHASEYKSGEEFRRQKVLVVGCGNSGMEISLDLVRHNASPHLVVRNTVHVLPREILGVSTFGVGMTLLKCLPLRLVDKFLLLMANLSFGNTDRLGLRRPKTGPLELKNVTGKSPVLDVGAMSLIRSGMIQIMEGVKEITKKGAKFMDGQEKDFDSIIFATGYKSNVPTWLQGGDFFTDDGMPKTPFPNGWRGGKGLYTVGFTRRGLLGTASDAVKIAGEIGDQWRDEIKGSTRNMCSSRFVFTSKS

SEQ ID NO: 236 - DNA, 1869 bp, Artificial Sequence
  Description of Artificial Sequence: Synthetic polynucleotide
atgattacggcggcggacttctaccacgttatgacggctatggttccgttatacgtagctatgatcctcgcttacggctctgtcaaatggtggaaaatcttcacaccagaccaatgctccggcataaaccgtttcgtcgctctcttcgccgttcctctcctctctttccacttcatcgccgctaacaacccttacgccatgaacctccgtttcctcgccgcagattctctccagaaagtcattgtcctctctctcctcttcctctggtgcaaactcagccgcaacggttctttagattggaccataactctcttctctctctcgacactccccaacactctagtcatggggatacctcttctcaaaggcatgtatggtaatttctccggcgacctcatggttcaaatcgttgttcttcagtgtatcatttggtacacactcatgctctttctctttgagtaccgtggagctaagcttttgatctccgagcagtttccagacacagcaggatctattgtttcgattcatgttgattccgacattatgtctttagatggaagacaacctttggaaactgaagctgagattaaagaagatgggaagcttcatgttactgttcgtcgttctaatgcttcaaggtctgatatttactcgagaaggtctcaaggcttatctgcgacacctagaccttcgaatctaaccaacgctgagatatattcgcttcagagttcaagaaacccaacgccacgtggctctagttttaatcatactgatttttactcgatgatggcttctggtggtggtcggaactctaactttggtcctggagaagctgtgtttggttctaaaggtcctactccgagaccttccaactacgaagaagacggtggtcctgctaaaccgacggctgctggaactgctgctggagctgggaggtttcattatcaatctggaggaagtggtggcggtggaggagcgcattatccggcgccgaacccagggatgttttcgcccaacactggcggtggtggaggcacggcggcgaaaggaaacgctccggtggttggtgggaaaagacaagacggaaacggaagagatcttcacatgtttgtgtggagctcaagtgcttcgccggtctcagatgtgttcggcggtggaggaggaaaccaccacgccgattactccaccgctacgaacgatcatcaaaaggacgttaagatctctgtacctcaggggaatagtaacgacaaccagtacgtggagagggaagagtttagtttcggtaacaaagacgatgatagcaaagtattggcaacggacggtgggaacaacataagcaacaaaacgacgcaggctaaggtgatgccaccaacaagtgtgatgacaagactcattctcattatggtttggaggaaacttattcgtaatcccaactcttactccagtttattcggcatcacctggtccctcatttccttcaagtggaacattgaaatgccagctcttatagcaaagtctatctccatactctcagatgcaggtctaggcatggctatgttcagtcttgggttgttcatggcgttaaacccaagaataatagcttgtggaaacagaagagcagcttttgcggcggctatgagatttgtcgttggacctgccgtcatgctcgttgcttcttatgccgttggcctccgtggcgtcctcctccatgttgccattatccaggcagctttgccgcaaggaatagtaccgtttgtgtttgccaaagagtataatgtgcatcctgacattcttagcactgcggtgatatttgggatgttgatcgcgttgcccataactcttctctactacattctcttgggtctatga

SEQ ID NO: 237 - protein, 622 aa, Artificial Sequence
  Description of Artificial Sequence: Synthetic polypeptide
MITAADFYHVMTAMVPLYVAMILAYGSVKWWKIFTPDQCSGINRFVALFAVPLLSFHFIAANNPYAMNLRFLAADSLQKVIVLSLLFLWCKLSRNGSLDWTITLFSLSTLPNTLVMGIPLLKGMYGNFSGDLMVQIVVLQCIIWYTLMLFLFEYRGAKLLISEQFPDTAGSIVSIHVDSDIMSLDGRQPLETEAEIKEDGKLHVTVRRSNASRSDIYSRRSQGLSATPRPSNLTNAEIYSLQSSRNPTPRGSSFNHTDFYSMMASGGGRNSNFGPGEAVFGSKGPTPRPSNYEEDGGPAKPTAAGTAAGAGRFHYQSGGSGGGGGAHYPAPNPGMFSPNTGGGGGTAAKGNAPVVGGKRQDGNGRDLHMFVWSSSASPVSDVFGGGGGNHHADYSTATNDHQKDVKISVPQGNSNDNQYVEREEFSFGNKDDDSKVLATDGGNNISNKTTQAKVMPPTSVMTRLILIMVWRKLIRNPNSYSSLFGITWSLISFKWNIEMPALIAKSISILSDAGLGMAMFSLGLFMALNPRIIACGNRRAAFAAAMRFVVGPAVMLVASYAVGLRGVLLHVAIIQAALPQGIVPFVFAKEYNVHPDILSTAVIFGMLIALPITLLYYILLGL

SEQ ID NO: 238 - DNA, 1176 bp, Artificial Sequence
  Description of Artificial Sequence: Synthetic polynucleotide
atggtgaaactggagaactcgaggaaacccgaaaaaatttcgaacaagaacatccccatgtccgatttcgtggtcaatctggatcatggtgatccaacggcgtacgaagaatactggaggaagatgggtgacaggtgtacggtgacgatacgtggttgtgatctcatgagttacttcagcgacatgacgaacttgtgttggttccttgagccagagcttgaagatgcgatcaaggacttgcacggtgttgttggtaacgctgcgacggaggatcggtacatagtggttgggaccggttcgacgcagctttgtcaagccgccgtccacgcactctcttcactagccaggagtcaacctgtcagcgtcgtcgccgccgctcctttttactccacatatgtggaggagacgacatatgttcggtcgggtatgtacaagtgggaaggagacgcatggggtttcgacaaaaagggtccgtacatcgagctagtgacgtcacctaataaccctgacggaaccatcagagagacggtggtgaaccgtccagacgacgacgaagccaaagtgatccatgactttgcttattactggccccactacactcccatcactcgccgtcaagaccatgacatcatgctcttcactttctccaagatcacaggccacgctgggtcccgtattgggtgggcattggtgaaggacaaggaggtagctaagaagatggttgagtatattattgtgaactcgattggtgtgtctaaggagtcacaggttcgaacagctaagatactcaacgttctaaaggagacttgtaagagcgagtccgagtctgagaatttcttcaagtatggtcgtgagatgatgaagaatcggtgggagaagctacgtgaagttgtgaaagagagcgatgctttcactcttcccaagtaccctgaagcattttgcaactactttggaaaatcactcgaatcttaccctgcgtttgcgtggctagggacgaaggaagagacggatctggtaagtgaattgaggagacacaaggtaatgagcagagctggagagcgttgtggatctgacaagaagcatgtccgagtcagcatgcttagtcgtgaagacgttttcaatgtctttctcgagagactcgccaacatgaagctcattaaaagcattgacctttag

SEQ ID NO: 239 - protein, 391 aa, Artificial Sequence
  Description of Artificial Sequence: Synthetic polypeptide
MVKLENSRKPEKISNKNIPMSDFVVNLDHGDPTAYEEYWRKMGDRCTVTIRGCDLMSYFSDMTNLCWFLEPELEDAIKDLHGVVGNAATEDRYIVVGTGSTQLCQAAVHALSSLARSQPVSVVAAAPFYSTYVEETTYVRSGMYKWEGDAWGFDKKGPYIELVTSPNNPDGTIRETVVNRPDDDEAKVIHDFAYYWPHYTPITRRQDHDIMLFTFSKITGHAGSRIGWALVKDKEVAKKMVEYIIVNSIGVSKESQVRTAKILNVLKETCKSESESENFFKYGREMMKNRWEKLREVVKESDAFTLPKYPEAFCNYFGKSLESYPAFAWLGTKEETDLVSELRRHKVMSRAGERCGSDKKHVRVSMLSREDVFNVFLERLANMKLIKSIDL

SEQ ID NO: 240 - DNA, 4107 bp, Artificial Sequence
  Description of Artificial Sequence: Synthetic polynucleotide
atgggtgagaaagcgattgacgaagacaaagtagaagcgatgaagagcagcaagacctctcttgttttcgccattaacggacaaagattcgagctcgagctctcttctattgatccttccaccacactcgtcgatttcttgcgcaacaagactcctttcaagagcgtcaagcttggttgtggcgaaggtggttgtggcgcttgtgttgttcttctttcaaagtatgatccattgctcgaaaaagtcgatgaattcacaattagctcgtgtctcacgcttctctgtagcattgatggctgttccatcactacctcagacgggctcggcaacagcagagtcggtttccatgccgtccacgagcgtatcgccggttttcatgccacacaatgcggtttctgtactcctggaatgagcgtttcgatgttttctgctctcttgaacgctgataagtctcatccacctcctcgcagcggtttctcaaatctcacggctgtagaagctgagaaggctgtgtcagggaatctttgccggtgtactggatatagaccgcttgtggatgcttgtaagagttttgcagcggatgtggatatcgaagatctcggattcaatgccttttgcaagaagggagaaaacagagatgaggttttaagaaggttgccatgttatgatcatacatcatctcatgtctgtacatttccggagttcttgaagaaggaaatcaagaacgatatgagtcttcattcaagaaagtatcgatggtcaagcccggttagtgtctcagagcttcaagggttattagaagtcgagaatggtttgtcggttaagttagttgcgggtaacacgagcaccgggtattacaaagaagaaaaagagaggaagtacgaaagatttatcgatatcaggaagattccggagtttactatggtgagaagtgatgagaaaggagttgaattaggagcttgtgtcactatatcgaaagctattgaggttctaagagaggaaaaaaatgtttctgtgttggcgaaaatcgctactcatatggagaaaattgcaaacagattcgtgaggaacacgggaacgataggtggaaacattatgatggctcagagaaaacagtttccttcggatcttgcaaccatacttgttgctgctcaagcaacggtgaagatcatgactagcagctcgagtcaagaacagttcacattggaggagtttctacaacaacctcctcttgatgcaaaatctcttcttttgagcctcgagattccatcttggcactccgcgaagaagaacggttcttcagaagatagtattttgctatttgaaacttacagagcagcgcctcgtcctctaggaaacgcattggcatttctgaatgcggctttctcagctgaagttactgaagcacttgatggcattgttgtaaatgattgccaattagtttttggagcttatgggaccaaacatgcacacagggcaaagaaagtagaagagtttcttacaggaaaagtgatatctgatgaagttttgatggaagctattagcttacttaaagatgagatagtacctgataagggtacttcgaatcccgggtatagatcaagcttggctgttacttttctcttcgagttcttcggatctttaactaaaaaaaacgctaaaacgacaaacggttggctcaatggaggatgcaaagagattggttttgatcagaatgttgaatctttgaaacctgaagctatgctgtcatctgcacaacaaatagttgaaaatcaagagcatagtccggtcgggaaaggcattacaaaggctggagcttgtctccaagcatctggtgaggctgtttatgtagacgacattcctgctccggaaaattgtctatacggcgcatttatttacagtacaatgccgctagcgcgaattaagggtataaggttcaagcaaaacagagttccagaaggagttcttggcattattacttacaaagatattcccaaaggcgggcaaaatatcggtaccaacggtttctttacctcggatcttttgttcgcagaagaagtcactcattgtgcgggtcagataatcgcctttttggttgcagatagtcaaaagcatgcagatattgcagcaaatcttgttgtgatagattacgacaccaaagatttaaaaccacctatactgtccttagaagaagctgtcgaaaactttagccttttcgaggtccctccacctctgcgtggttacccggttggtgatatcaccaagggaatggatgaagctgaacataagattcttggatcaaagataagtttcgggtcacagtacttcttctatatggagacacaaacagctcttgcagtgccggatgaagacaactgtatggtggtttatagctcgactcaaacccctgagtttgtacatcaaaccatcgctggatgtcttggagttcctgagaacaatgtgcgtgtcatcactagaagagttggaggcggattcggtgggaaagccgtgaaatcaatgcctgttgctgcagcttgtgcacttgcagcatccaaaatgcagcgtcctgtgaggacatatgtgaaccgaaaaacggatatgataactaccggaggaagacatccgatgaaagtcacatatagtgttggattcaaatccaatggaaagattactgctttagatgtagaggtgttacttgatgcagggttaaccgaagatataagcccgcttatgccgaagggaatacaaggagcactaatgaagtatgattggggtgctctgtctttcaatgtgaaagtatgcaaaacaaacactgtgagcagaaccgcgctgagagctcctggggatgtacaaggatcatatataggagaagccatcattgaaaaagtagcttcatatctttcagttgatgttgatgagatcaggaaggttaatcttcatacatatgagagcttaaggttgtttcacagtgccaaagctggtgaattttctgagtatacgttaccattgctttgggacagaatcgatgagttctcgggatttaacaagcggaggaaggtggttgaggagtttaatgcatcaaacaagtggagaaagagagggatttcacgtgtgcctgcggtttatgcagtgaacatgcgatcaacaccgggaagagtaagcgttttgggagatgggtcaatagttgtggaggttcaagggattgagataggacaagggctttggacaaaggtgaaacagatggctgcatattcccttggtttgatccagtgcggtactacaagtgatgaactgcttaaaaaaatcagggtcattcaatccgacacactaagtatggtgcaaggctcaatgactgctggtagtacaacctctgaagcgagtagtgaagcggtaaggatttgctgtgatggcttagttgaaaggcttttaccagtcaagaccgctttggtggagcaaacaggaggacctgtgacttgggatagtctcatcagtcaggcttatcagcaatcgataaacatgtccgttagtagcaaatacatgcctgactccactggcgaatacctgaactatggaattgcagcgagcgaggttgaagtaaacgttttgacgggagaaacaacgatcctgcgtacagatattatctatgattgtgggaagagtctcaatcccgctgttgatttaggacagattgaaggagcctttgttcaaggacttggtttcttcatgcttgaagagttcctaatgaactcagacggtctcgtggtaacagacagcacatggacttacaagatcccaacggttgacacaatcccaagacagtttaatgtggagattctcaacagtggacaacacaagaatcgtgttctttcatccaaagcttcgggtgaaccgccattgcttttagcggcttctgttcactgcgcggtacgagcagctgttaaagaagctaggaaacagatcctgtcatggaatagtaataaacaagggactgatatgtacttcgaattgcctgttccagcaacaatgcctattgtgaaggagttttgtggacttgatgttgtcgagaaatacttggaatggaaaatccagcaaaggaaaaatgtttga

SEQ ID NO: 241 - protein, 1368 aa, Artificial Sequence
  Description of Artificial Sequence: Synthetic polypeptide
MGEKAIDEDKVEAMKSSKTSLVFAINGQRFELELSSIDPSTTLVDFLRNKTPFKSVKLGCGEGGCGACVVLLSKYDPLLEKVDEFTISSCLTLLCSIDGCSITTSDGLGNSRVGFHAVHERIAGFHATQCGFCTPGMSVSMFSALLNADKSHPPPRSGFSNLTAVEAEKAVSGNLCRCTGYRPLVDACKSFAADVDIEDLGFNAFCKKGENRDEVLRRLPCYDHTSSHVCTFPEFLKKEIKNDMSLHSRKYRWSSPVSVSELQGLLEVENGLSVKLVAGNTSTGYYKEEKERKYERFIDIRKIPEFTMVRSDEKGVELGACVTISKAIEVLREEKNVSVLAKIATHMEKIANRFVRNTGTIGGNIMMAQRKQFPSDLATILVAAQATVKIMTSSSSQEQFTLEEFLQQPPLDAKSLLLSLEIPSWHSAKKNGSSEDSILLFETYRAAPRPLGNALAFLNAAFSAEVTEALDGIVVNDCQLVFGAYGTKHAHRAKKVEEFLTGKVISDEVLMEAISLLKDEIVPDKGTSNPGYRSSLAVTFLFEFFGSLTKKNAKTTNGWLNGGCKEIGFDQNVESLKPEAMLSSAQQIVENQEHSPVGKGITKAGACLQASGEAVYVDDIPAPENCLYGAFIYSTMPLARIKGIRFKQNRVPEGVLGIITYKDIPKGGQNIGTNGFFTSDLLFAEEVTHCAGQIIAFLVADSQKHADIAANLVVIDYDTKDLKPPILSLEEAVENFSLFEVPPPLRGYPVGDITKGMDEAEHKILGSKISFGSQYFFYMETQTALAVPDEDNCMVVYSSTQTPEFVHQTIAGCLGVPENNVRVITRRVGGGFGGKAVKSMPVAAACALAASKMQRPVRTYVNRKTDMITTGGRHPMKVTYSVGFKSNGKITALDVEVLLDAGLTEDISPLMPKGIQGALMKYDWGALSFNVKVCKTNTVSRTALRAPGDVQGSYIGEAIIEKVASYLSVDVDEIRKVNLHTYESLRLFHSAKAGEFSEYTLPLLWDRIDEFSGFNKRRKVVEEFNASNKWRKRGISRVPAVYAVNMRSTPGRVSVLGDGSIVVEVQGIEIGQGLWTKVKQMAAYSLGLIQCGTTSDELLKKIRVIQSDTLSMVQGSMTAGSTTSEASSEAVRICCDGLVERLLPVKTALVEQTGGPVTWDSLISQAYQQSINMSVSSKYMPDSTGEYLNYGIAASEVEVNVLTGETTILRTDIIYDCGKSLNPAVDLGQIEGAFVQGLGFFMLEEFLMNSDGLVVTDSTWTYKIPTVDTIPRQFNVEILNSGQHKNRVLSSKASGEPPLLLAASVHCAVRAAVKEARKQILSWNSNKQGTDMYFELPVPATMPIVKEFCGLDVVEKYLEWKIQQRKNV

SEQ ID NO: 242 - DNA, 1278 bp, Artificial Sequence
  Description of Artificial Sequence: Synthetic polynucleotide
atggcgaccaataatgattttggagctttcattgagaaagttacaatctctccaacttctacttcctcgtcgcctccttctctacagggtcttactttcgccattaaagacatttttgatgtggaaggacgcgttaccggttttggtaacccggattggttaaggacacactcggcagctacttctacagctccagtagtttcatctctcttagaagctggtgccacagctttgggtattaccattatggatgaaatggcttacagtataaacggagaaaatgcgcattatgggactccgagaaacccgattgctttcgatagagtgcctgggggatcatcgagtggctcagccgtagctgtagctgctcgtcttgtggatttttctattggaactgataccggagggagtgtacgagttccagcatcttactgtgggattttcggtttccggccatcccacggtgcagtttccactgtcggacttactccaatggctcagagcttcgacacagttggatggtttgctcgggacacagccactttgaaacgtgtaggttgcgttctcctgcagcagcatcacttgaaccccatcgaaccatctcaactgattatcgcggatgactgcttcaagctgtgtagtgtaccgcatgatctcttggtgcagcctctggttggatccgtggaaaaatcgtttggaggcaacactgtagtaaagaaggtgaatcttggagagtacattggacagaatgttccaagccttaaacatttcatgacaagtgacgatgtcactacacaacaagagttctgcattccgtctctcatggccctatcgagttcaatgagattgttacaaagacatgaattcaagataaaccacggtgcatggatctcgtcggtgaagccagagtttggtcctggaatatcagaacgaattgaggaagctatcagaacatccgacgagaagatcgaccattgccggtccgtgaaatctgaactgataacggctctttcaactttgctcggggagaagggtgtgttggtgattccaacggtaccaggtcctccaccgcatctccaagctaatgtggctgcacttgaatctttccgcagcagagccttcagcttgttgtcgatcgcaggcgtttctggattctgtcaggtgagcataccattggggctacacgaaaatcttccggtttcggtatcattggtagctaagtatggctcagacggttttcttctgagtcttgtggattcccttgctgcatttatttga

SEQ ID NO: 243 - protein, 425 aa, Artificial Sequence
  Description of Artificial Sequence: Synthetic polypeptide
MATNNDFGAFIEKVTISPTSTSSSPPSLQGLTFAIKDIFDVEGRVTGFGNPDWLRTHSAATSTAPVVSSLLEAGATALGITIMDEMAYSINGENAHYGTPRNPIAFDRVPGGSSSGSAVAVAARLVDFSIGTDTGGSVRVPASYCGIFGFRPSHGAVSTVGLTPMAQSFDTVGWFARDTATLKRVGCVLLQQHHLNPIEPSQLIIADDCFKLCSVPHDLLVQPLVGSVEKSFGGNTVVKKVNLGEYIGQNVPSLKHFMTSDDVTTQQEFCIPSLMALSSSMRLLQRHEFKINHGAWISSVKPEFGPGISERIEEAIRTSDEKIDHCRSVKSELITALSTLLGEKGVLVIPTVPGPPPHLQANVAALESFRSRAFSLLSIAGVSGFCQVSIPLGLHENLPVSVSLVAKYGSDGFLLSLVDSLAAFI

SEQ ID NO: 244 - DNA, 1248 bp, Artificial Sequence
  Description of Artificial Sequence: Synthetic polynucleotide
atgggttcttgtaaagaagaagaaaaaactgatcaacaaccaaaatggttatgggttaatggacctataatagtaggtgctggaccttctggtttagcagtttcagcttctcttaaagaaaatggagtcccttcacttattcttgaaagaagtgattgtattgcttctttatggcaacaaaaaacctatgatcgtttaaaacttcatctccctaaacagttttgtcaactcccattatttggttttcctgaaaatttccctaaatacccttcaaaaaaacagttcatttcttacttagaggattatgctaaacactttggtataattcccaagtttaaacagtctgtaaaagttgcagaatttgatcatgttagtggattttggaaggtggaaactcaagattttttgtatctttcaaagtggttgattgtggctacaggggaaaatgcagagccagttataccagaaattcaagggattggtaagtttaaaggaacagtaatgcatactagtctttataagtctggtactgagtttaataatcaaagggttttggtaattggctgtggaaattctggtatggaagttagcttggacctttgtagacataatgccatccctcacatggtcgtcagaaattccgtgcatattttaccaagggaaatgttagggatatcaacattttcaatagcaatggcacttctcaaatggttgcctataagagttgttgacaagttgctattactagtagccaatttgaccttaggtagcacagataagttaggtctccggcgaccaaaaaccggtccacttgaactgaaaaatgccaccggaaaaactccggtactcgacgttggtgcattgtcacaaataagaaatggaaaaattcagattatgcacggtgtgaaggagataactaaaataggagcaaagtctatagatggaaaagaaggagaatttgattcaataatcctagcaactggatacaaaagcaatgttccttcttggcttaagggaactgacttcttcacagaacaagggatgccaaaaacaccatttcctaatggctggaaaggggaaaatggattatacacggtggggtttacaagaagagggcttttagggactgcaaatgatgcaaaaaacattgccagggatattagtgatcaatggaggaaatacaagggcttctgcaaaaatttttgtacttcaagaaatctatcagatagccagggtatatgtttttag

SEQ ID NO: 245 - protein, 415 aa, Artificial Sequence
  Description of Artificial Sequence: Synthetic polypeptide
MGSCKEEEKTDQQPKWLWVNGPIIVGAGPSGLAVSASLKENGVPSLILERSDCIASLWQQKTYDRLKLHLPKQFCQLPLFGFPENFPKYPSKKQFISYLEDYAKHFGIIPKFKQSVKVAEFDHVSGFWKVETQDFLYLSKWLIVATGENAEPVIPEIQGIGKFKGTVMHTSLYKSGTEFNNQRVLVIGCGNSGMEVSLDLCRHNAIPHMVVRNSVHILPREMLGISTFSIAMALLKWLPIRVVDKLLLLVANLTLGSTDKLGLRRPKTGPLELKNATGKTPVLDVGALSQIRNGKIQIMHGVKEITKIGAKSIDGKEGEFDSIILATGYKSNVPSWLKGTDFFTEQGMPKTPFPNGWKGENGLYTVGFTRRGLLGTANDAKNIARDISDQWRKYKGFCKNFCTSRNLSDSQGICF

SEQ ID NO: 246 - DNA, 1167 bp, Artificial Sequence
  Description of Artificial Sequence: Synthetic polynucleotide
atgggttcttataaagaagaagaaaaaaccgatcaacaaccaaaatggttatgggttaatggacctataatagtaggtgctggaccttctggtttagcagtttcagcttgtcttaaagaaaatggagtcccttcacttattcttgaaagaagtgattgtattgcttctttatggcaacaaaaaacttatgatcgtttaaaacttcatctccctaaacagttttgtcaactcccattatttggttttcctgaaaattttcctaaatacccttcaaaaaaactgttcatttcttacttagaggattatgctaaacactttggtatagttcctaagtttaaacagtctgttaaagttgcagaatttgatcatgttagtggattttggaaggtagaaactcaagattttttgtatctttcaaaatggttgattgtggctacaggagaaaatgcagagccagtaataccagaaattcaagggattgataagtttaaaggagcggtgttgcatactagtgtttataagtcaggtactgagtttaataatcaaagggttttggtaattggttgtggaaattctggtatggaagttagcttggacctttgtagacataatgccatccctcacatggtcgtcagaaattctgtgcatattttaccaagggaaatgttagggatatcaacattttcaatagcaatggcacttctcaaatggttgcctataagagtagttgacaagttgctgttactagtagcaaatttgaccttaggtagcacagataagttaggtctccggcgaccaaaaaccggtccacttgaactgaaaaatgccacggaaaaactcgtctcgacgttgattatgcacggtgtgaaggagataactaaaataggagcaaagtttatagatggaaaagaaggagaatatgattcaataatcttagcaactggatacaaaagcaatgttccttcttggcttaagggaactgacttcttcacagaacaagggatgccaaagacaccatttccaaatggttggaaaggggaaaatggattatacacagtggggtttacaagaagagggcttttagggactgcaaatgatgcaaaaaaaattgccagggacataagtgatcaatggaggaaatacaagggcttctgcaaaaacttttga

SEQ ID NO: 247 - protein, 388 aa, Artificial Sequence
  Description of Artificial Sequence: Synthetic polypeptide
MGSYKEEEKTDQQPKWLWVNGPIIVGAGPSGLAVSACLKENGVPSLILERSDCIASLWQQKTYDRLKLHLPKQFCQLPLFGFPENFPKYPSKKLFISYLEDYAKHFGIVPKFKQSVKVAEFDHVSGFWKVETQDFLYLSKWLIVATGENAEPVIPEIQGIDKFKGAVLHTSVYKSGTEFNNQRVLVIGCGNSGMEVSLDLCRHNAIPHMVVRNSVHILPREMLGISTFSIAMALLKWLPIRVVDKLLLLVANLTLGSTDKLGLRRPKTGPLELKNATEKLVSTLIMHGVKEITKIGAKFIDGKEGEYDSIILATGYKSNVPSWLKGTDFFTEQGMPKTPFPNGWKGENGLYTVGFTRRGLLGTANDAKKIARDISDQWRKYKGFCKNF

SEQ ID NO: 248 - DNA, 1833 bp, Artificial Sequence
  Description of Artificial Sequence: Synthetic polynucleotide
atgataactttatctgatttctaccatgttatgactgctgttgtgccactttatgtggctatgatattagcttatggttctgttaaatggtggaagattttttcacctgaccagtgttctggtattaacagatttgttgcacttttcgcagttccacttctctctttccactttatagctgctaataatccttacactatgaacatacggttcattgctgctgacactcttcagaaacttattgttcttggagctcttgctatttgggctaattttagcaaaaggggtagtttagaatggagtataacactcttttctttatcaactcttccaaatactttagttatgggtattcctttgttaaaaggaatgtatggtgatttttcagggagtttaatggttcaaatagttgtactacagtgtattatttggtacactttgatgctttttatgtttgagttcagaggtgcaaggatgctgatctctgagcaatttcctgatactgctggctcaattgtctcaatccatgttgattctgatgtcatgtcattagatggtagacaagttttggaaactgaagctgaagtgaaagaagatggaaaacttcatgttactgtgagaaaatcaaatgcctcaaggtctgatatattttcaagaaggtcgcagggattttcttctacaactccaagaccatcaaatttaacaaatgcagagatttactctctacaatcttcaagaaatccaactccaagagggtcaagttttaaccatactgatttttactcaatggttgctggtgggagaaactcaaactttggtgcaaatgatgtttatgggatgtcagcttcaagaggaccaactcctagaccttcaaattatgaggaagaaagtggaaaatcaagatttaattacaaccatggagctgcagcacaacaaagtaatactaataataatactactcattatccagctccaaatcctggtatgttttcacctagtaatggtgcaaaagcagtgggttctaacactaataacaagaaaggtaacaaaggagaggaaggtggtaaagatcttcatatgtttgtttggagttcaagtgcttctcctgtttctgatgtatttggtggtcatgattatggagctaatttagaccagaatacagctaaggatgtaagagtacctatctctcctggaaaagttgaggtgcaaagaaacaatcaagaaaactacatggagagagatgactttagctttgcaaatagagatgcagaaatgaatattcacaaccaagaaggtgaaaaaggtggagaaaataaagcaaaggttatgccaccaacaagtgtaatgactaggcttatactaattatggtttggaggaaacttattagaaatccaaacacttattcaagcttgtttggtctcacttggtctctagtttcattcaggtggaatttgaagatgcctgctataattgcacagtccatatctatattgtcagatgcaggacttggcatggcaatgttcagtctaggtctgtttatggctttgcaaccaaggataatagcatgtgggaattctacagcagcttttgctatggctgtgagattccttacaggtccagctgtcatggcagctgcttccattgctgttggccttcgtggagttctcttacacgtagccattgtacaggcagctctaccccaaggaattgtcccctttgtcttcgccaaggaatacaacgttcaccctgacattcttagcacgggtgtcatttttgggatgttgattgccttgccgattacactggtctactacattttgatgggactttaa

SEQ ID NO: 249 - protein, 610 aa, Artificial Sequence
  Description of Artificial Sequence: Synthetic polypeptide
MITLSDFYHVMTAVVPLYVAMILAYGSVKWWKIFSPDQCSGINRFVALFAVPLLSFHFIAANNPYTMNIRFIAADTLQKLIVLGALAIWANFSKRGSLEWSITLFSLSTLPNTLVMGIPLLKGMYGDFSGSLMVQIVVLQCIIWYTLMLFMFEFRGARMLISEQFPDTAGSIVSIHVDSDVMSLDGRQVLETEAEVKEDGKLHVTVRKSNASRSDIFSRRSQGFSSTTPRPSNLTNAEIYSLQSSRNPTPRGSSFNHTDFYSMVAGGRNSNFGANDVYGMSASRGPTPRPSNYEEESGKSRFNYNHGAAAQQSNTNNNTTHYPAPNPGMFSPSNGAKAVGSNTNNKKGNKGEEGGKDLHMFVWSSSASPVSDVFGGHDYGANLDQNTAKDVRVPISPGKVEVQRNNQENYMERDDFSFANRDAEMNIHNQEGEKGGENKAKVMPPTSVMTRLILIMVWRKLIRNPNTYSSLFGLTWSLVSFRWNLKMPAIIAQSISILSDAGLGMAMFSLGLFMALQPRIIACGNSTAAFAMAVRFLTGPAVMAAASIAVGLRGVLLHVAIVQAALPQGIVPFVFAKEYNVHPDILSTGVIFGMLIALPITLVYYILMGL

SEQ ID NO: 250 - DNA, 1191 bp, Artificial Sequence
  Description of Artificial Sequence: Synthetic polynucleotide
atgtgtggcacagaggcttgtcttatcaagtgttctccagtcccttgtgtgactcctgaaacaagagaaaatggcactctcatcaagtgggatactcttatcaatcttgatcatggtgatccagtaatgtatgaatcatactggcgaaagatgggaaacaggtgtgacattacattcagtggttatcagtcattgagttattttgctaacgccaagaacttgtgctggttccttgagccaaaactagaagaagagatcaagaggctgcacaatgtggttggaaatgcaattgtggatgatcattatatcgtcgttgggacaggatcaagccagcttatacaggctgcactctatgctctttctcctacagatgaacctgaaccaatcagtgtagtttcagctgcacctttctattcgtcatatccagaagtgactgattttgtgcgttcagggctgtacaaatgggcaggagatgcaagaaattttgagaaagatggaccatatattgagttcattacatctccaaataacccagatggggttactcgagagcctgtagttaatggaattcaagggatattaattcatgatttagcttattactggccacagtacactgctattacctctcctgccaaatatgatgttatgctctttacagtttccaaatgcactggccatgctggatccagaattggttgggctcttgttagggacaaagaggtggctaggaagatgacaaaattcatggaaattagcacaataggggtatcaaaggaagctcaattgagagctgcaaagattcttggactgatttctgatagctgtttagatcccacattggaaaacttctttgagtatagtcaatctcacatgactaaaagatggcagaggttaagagaagttgttaagagcagtgaccttttcactctccagaaatatccacttcagtattgccacttcacaagagacttctatgaatcacaccctgcttttgcatggctaatgtgcaaaggaagtgaagatgaccttgagaagcttcttaaaggatacaagattcaaacaaggagtggaagaaaatttgggagtgatccaaaatgtgttaggataagtatgctgagtagggatgaagacttcaacatttttttgcagaggcttatgtctattcaaggagttacaaatggaaattaa

SEQ ID NO: 251 - protein, 396 aa, Artificial Sequence
  Description of Artificial Sequence: Synthetic polypeptide
MCGTEACLIKCSPVPCVTPETRENGTLIKWDTLINLDHGDPVMYESYWRKMGNRCDITFSGYQSLSYFANAKNLCWFLEPKLEEEIKRLHNVVGNAIVDDHYIVVGTGSSQLIQAALYALSPTDEPEPISVVSAAPFYSSYPEVTDFVRSGLYKWAGDARNFEKDGPYIEFITSPNNPDGVTREPVVNGIQGILIHDLAYYWPQYTAITSPAKYDVMLFTVSKCTGHAGSRIGWALVRDKEVARKMTKFMEISTIGVSKEAQLRAAKILGLISDSCLDPTLENFFEYSQSHMTKRWQRLREVVKSSDLFTLQKYPLQYCHFTRDFYESHPAFAWLMCKGSEDDLEKLLKGYKIQTRSGRKFGSDPKCVRISMLSRDEDFNIFLQRLMSIQGVTNGN

SEQ ID NO: 252 - DNA, 4062 bp, Artificial Sequence
  Description of Artificial Sequence: Synthetic polynucleotide
atggaacagaaaaaagggaatttagtttttgcagtaaatggagagaggtttgagttgccaaatattgacccctctactactttacttcagttcttgcgttctgagacttgtttcaagagtcctaaacttggttgtggtgaaggtggttgtggggcttgtgttgttctggtctcaaagtatgatcctaagcttaaaaaggtcgaagattttagcgcgagttcatgccttacacttctttgtagtttaaatggttactcaattactacaagtgaaggccttgggaacaccagagatggttttcactctattcatgaaagatttgctggtttccatgcttctcaatgtggcttttgcactcctggaatgtgtatgtcatttttctcagctcttgtcaatgccgataaaggaaacaagccggatcctccaccaggattttctaagcttacttcatctgaagctgaaaaggccatagcagggaacctctgtcggtgcactggataccggcctattgctgatgcctgcaagacttttgctgctgatattgatatagaggatttggggttcaattctttttggaaaaagggagattccaaggaattgaaaataagtaaattacctccttatgatccaaccaagaattttagtacatatccggagttcttgaaaagtgaatgcgccacaaatttggactccacaaggtacccttggtacagtcctacttccattgaagagctgcagagcttgttgaactccagtgtggcggataatggtgcgagctttaaactggtcgttggtaatacaggcacaggttattataaggaaactcagcgatatgatcattacgttgatctcaggtatattcctgaactctcaatcatcaaaagagatcagacaggcattgaagtgggagcaactgtgactatctctaaacttatagcattcttgaaagaggaaaacaaagtcaatttgggtccatatgggaagctggtgtccgaaaagctggttaaccacatggagaagattgcttcaccatttgttaggaactctgctagtgtgggaggaaatttggttatggcacaaaagaatggttttccttcagatattgctacattatttcttggtgtgggtgctaccgttagcttgatgaccggtcatggacttgaaaaactcacatgggaggaattattatcgagaccgccaatagactcaaggaccgtgcttctaagtgtttggatcccatttaaagaagagagttctctcaaaacctttactaagtttttgtttgagacctatcgagctgctccccgacctcatgggaatgcaatagcatatgtaaacgctgcttttggggttgatgtttctctctgccagaacggcatcctgataaacgatatccggctggcgtttggtgcttatggtacaaaacatgcaacaagggctaaaatggtagaggaatatctaacagggaaaatattaaatgcacatgttttaagtgaagcacttaaattagtcaaactagctgtggtaccggaagatgggactttacacccagagtatagatcaagcttggccgtcagttatgtttttcagtttctttatcccttagttgatgttcattctgctattgtcaatggaatcaatgacatctcactcgaggaagtttcaaaaagtagtaatgatagtcaggggagaaaacaaacactactgtcttcttctaagcaggttgtggaatcaagtagcgagcactatccagtgggtgaaccaatgaagaaggttggagctgccatgcaagctgctggtgaagctgtttatgtagatgacattccgtcaccaccaaactgcctgcacggagcatttatctacagcacaaaaccattagcaggtgtaaaaggaatccatcttgagtctaattcattaacagatggattcaccgacattattactttcaaggatatcccaagtggagggtcaaatgtaggatctattacaatgtttggtcctgagcctttattcgcagacgatctcgcccgatgtgctggcgacagaattgcagttgcggttgctgacactcagaggtctgctgatgtggctgccacaacagcccttgttgaatatgacactgtaaatgtaaattcaccgattttaactgtcgaggaagctgttgagaaatctagctttttccaaatcccgccatttctatatccaaaacaggttggcgatttctcaaaaggaatggctgaagctgatcacaagattctctctgctgaggtaagacttggttccgagtactatttttatatggagacacagactgcccttgcaattccagatgaagacaactgtatggttgtttatacttcaagccagtgccctgagtatgcgcaaaatgtgattgccagttgtcttggtgttcctgaacacaatatccgtgttattacaagaagggttggaggtggctttgggggcaaggcagtcagagcaatgcctgtttcgacagcctgtgcacttgcagcatacaagttaaggcggcctgtgaggataaatgtcaaccggaacagcgacatgataatgacaggaggaagacacccaatgaaagtaacatacagtgtaggattcaagtcaagcggaaagatcacagcattacatcttgatatattgataaatgctgggatttcggaagatataagccccctcctaccatcaaatgtgattaaagcattaaagaaatatgattggggtgccttatcttttgatgtaaaagtatgcaagacgaatcttaccagcaaatcagctatgcgggcccctggggaggtgcaaggatcttatattgccgaagctataatggagcatgtagcgagtttactgtcaaaggaggtggattctgtcagaaataataatgttcatacattggaaagcattaatttattctatgataacatcgtaactgaagtaggagaatatacgttgcctagtatcatggataagttggccgtgtcctcgagctttttccaacgtagcaagatggtggaacagtttaaccagaaaaacacatggaagaaaaagggtatttctcgactgccaataatgtttgaagctatgcaacgaccgaccccaggaaaagtcagtatcctgtcggatggatcaattgttgtagaggttggagggattgaaatcggccaagggctatggacaaaggttagacagatgactgcatatgctcttggtttaattgaaagtagttggagtgaagaacttgtagggaaagtacgagtcatacaagcagacagcttaagcttagtgcaaggtgggtatacggctggaagcactacatcggaatcaagctgtgaagcagttagacgttgctgtagtgtcttggttgaaagactgactcctctgaagaaacagttgcaggaacaaaatggctctcttgattggccaacgctcattcgccaggcacaaatgcaagcagtaaacttagcagcaaattcttattatgtaccagaatccagttccatgagttatttgaactttggtgccgctgtcagtgaggtggatatagatattcttactggagagactgccattttgcagtcggatattatttacgactgtgggcagagcttgaatccagctgtcgatatgggacagattgaaggagcttatgtacaaggaattggattttttatgcatgaagaatatcttacaaacgacgatgggttgatggtctcaaatagcacttggacatacaagatcccaacaatcgacaccataccccagaatttcaacgttcatttggtaaacagtggacatcacgaaaaacgtgttctctcttccaaagcatctggtgaaccgccactgctacttgcagcttcagtccattgtgcaacaagagcggctgttaaagcagcaagagaacaactcaaagtttggggcaagctcgacgagtctgcttcagaattctatctggatgttcctgccatattacctgttgtgaagacgcagtgtggtctagattatgtggagaaatacttagaaagtttactgactcagaaatctaactaa

SEQ ID NO: 253 - protein, 1353 aa, Artificial Sequence
  Description of Artificial Sequence: Synthetic polypeptide
MEQKKGNLVFAVNGERFELPNIDPSTTLLQFLRSETCFKSPKLGCGEGGCGACVVLVSKYDPKLKKVEDFSASSCLTLLCSLNGYSITTSEGLGNTRDGFHSIHERFAGFHASQCGFCTPGMCMSFFSALVNADKGNKPDPPPGFSKLTSSEAEKAIAGNLCRCTGYRPIADACKTFAADIDIEDLGFNSFWKKGDSKELKISKLPPYDPTKNFSTYPEFLKSECATNLDSTRYPWYSPTSIEELQSLLNSSVADNGASFKLVVGNTGTGYYKETQRYDHYVDLRYIPELSIIKRDQTGIEVGATVTISKLIAFLKEENKVNLGPYGKLVSEKLVNHMEKIASPFVRNSASVGGNLVMAQKNGFPSDIATLFLGVGATVSLMTGHGLEKLTWEELLSRPPIDSRTVLLSVWIPFKEESSLKTFTKFLFETYRAAPRPHGNAIAYVNAAFGVDVSLCQNGILINDIRLAFGAYGTKHATRAKMVEEYLTGKILNAHVLSEALKLVKLAVVPEDGTLHPEYRSSLAVSYVFQFLYPLVDVHSAIVNGINDISLEEVSKSSNDSQGRKQTLLSSSKQVVESSSEHYPVGEPMKKVGAAMQAAGEAVYVDDIPSPPNCLHGAFIYSTKPLAGVKGIHLESNSLTDGFTDIITFKDIPSGGSNVGSITMFGPEPLFADDLARCAGDRIAVAVADTQRSADVAATTALVEYDTVNVNSPILTVEEAVEKSSFFQIPPFLYPKQVGDFSKGMAEADHKILSAEVRLGSEYYFYMETQTALAIPDEDNCMVVYTSSQCPEYAQNVIASCLGVPEHNIRVITRRVGGGFGGKAVRAMPVSTACALAAYKLRRPVRINVNRNSDMIMTGGRHPMKVTYSVGFKSSGKITALHLDILINAGISEDISPLLPSNVIKALKKYDWGALSFDVKVCKTNLTSKSAMRAPGEVQGSYIAEAIMEHVASLLSKEVDSVRNNNVHTLESINLFYDNIVTEVGEYTLPSIMDKLAVSSSFFQRSKMVEQFNQKNTWKKKGISRLPIMFEAMQRPTPGKVSILSDGSIVVEVGGIEIGQGLWTKVRQMTAYALGLIESSWSEELVGKVRVIQADSLSLVQGGYTAGSTTSESSCEAVRRCCSVLVERLTPLKKQLQEQNGSLDWPTLIRQAQMQAVNLAANSYYVPESSSMSYLNFGAAVSEVDIDILTGETAILQSDIIYDCGQSLNPAVDMGQIEGAYVQGIGFFMHEEYLTNDDGLMVSNSTWTYKIPTIDTIPQNFNVHLVNSGHHEKRVLSSKASGEPPLLLAASVHCATRAAVKAAREQLKVWGKLDESASEFYLDVPAILPVVKTQCGLDYVEKYLESLLTQKSN

SEQ ID NO: 254 - DNA, 1278 bp, Artificial Sequence
  Description of Artificial Sequence: Synthetic polynucleotide
atggagacatgtgaatatggagctctcattgagaaattcacactgcaaccaatttgctcttcttcagagcaagtccccttgaatggcttaacctttgccgtgaaagacatatttgatgtggaaggacatatcactggttttggaaatccagactgggccaagacccattctgcggcaacatctactgcaacaactgtgctcactcttttgaaggctggtgctacttgtattggtaaaactgtcatggatgaaatggcttacagcataaatggtgaaaatgttcattatggcacgcctttgaatcctgtttcaccagatcgggtacctggagggtcttcaagtggatctgcagttgcagtcggtgcaaagcttgtagatttctccttagggactgacactggaggaagtgttagagttcctgcatcatattgtggaatttatggtattcgaccttctcatggagttgtttcaactgccggagtcacacctatggcacaaagctttgatacagtggggtggtttgcaagggatcctctgatcttaaagcaagttggaagagtcctacttcaatctccccaaatgaaatccgtgcgtccaactaacagtatcattgcagaagactgttttaagctcctggattccaagagtaaccaattgattgaagtacttgttaactcagtggagaagctatatggaagtcatatgattaaatacgtgagtgtaggggattatattgagggaaatgttccaagtttgaagaaattcatgacgcttggaactggcaatgatgaatcttacattccatccttgctagctctctcagctgccatgcggttgcttcaaaggtatgaattcaaggagaatcatggagaatgggttagtacagtcaaacctagtttaggtccgggaatagcagaacgcgtatgggaagcgctgaaggccacagatgaaaatattgatgtgtgccactctgtgaaggctgagcttcgagcagctctcactgctctccttggggattctggtatacttgcaatcccaactgttcctggacctccaccaaaactaagaagcgagacaagtgcattggaaggatttcgtgttaaggcttttagtctgttatcaattgctggagtatctggattttgccaggtcagcatacctctggggatgcaagacaatcttcctatatcagtttctttactggtaaaacatggttcagactggttgctgcttgatgctgttgaagctattcacaaagttctcaaggggcaaatctga

SEQ ID NO: 255 - protein, 425 aa, Artificial Sequence
  Description of Artificial Sequence: Synthetic polypeptide
METCEYGALIEKFTLQPICSSSEQVPLNGLTFAVKDIFDVEGHITGFGNPDWAKTHSAATSTATTVLTLLKAGATCIGKTVMDEMAYSINGENVHYGTPLNPVSPDRVPGGSSSGSAVAVGAKLVDFSLGTDTGGSVRVPASYCGIYGIRPSHGVVSTAGVTPMAQSFDTVGWFARDPLILKQVGRVLLQSPQMKSVRPTNSIIAEDCFKLLDSKSNQLIEVLVNSVEKLYGSHMIKYVSVGDYIEGNVPSLKKFMTLGTGNDESYIPSLLALSAAMRLLQRYEFKENHGEWVSTVKPSLGPGIAERVWEALKATDENIDVCHSVKAELRAALTALLGDSGILAIPTVPGPPPKLRSETSALEGFRVKAFSLLSIAGVSGFCQVSIPLGMQDNLPISVSLLVKHGSDWLLLDAVEAIHKVLKGQI

SEQ ID NO: 256 - protein, 6 aa, Artificial Sequence
  Description of Artificial Sequence: Synthetic 6xHis tag
HHHHHH

What is claimed is:

1. A modified tobacco plant comprising no or reduced suckers compared to a control tobacco plant of the same variety when grown under comparable conditions, wherein said modified tobacco plant comprises a heterologous axillary meristem-specific promoter functional in a central zone, a peripheral zone, a rib zone, or any combination thereof operably linked to a nucleotide sequence encoding a mitogen-activated protein kinase kinase polypeptide having an amino acid sequence at least 95% identical or similar to SEQ ID NO: 233.

2. The modified tobacco plant of claim 1, wherein said heterologous axillary meristem-specific promoter comprises a nucleic acid sequence having at least 95% sequence identity to a polynucleotide selected from the group consisting of SEQ ID NOs: 113, 115-118, 148, 149, 151, 153, 155, 157, 159, and 204.

3. The modified tobacco plant of claim 1, wherein said reduced suckers comprises at least 10% fewer suckers.

4. The modified tobacco plant of claim 1, wherein said reduced suckers comprises reduced mass, reduced length, or both.

5. The modified tobacco plant of claim 1, wherein said modified tobacco plant requires reduced management for controlling suckers compared to a control tobacco plant when grown under comparable conditions.

6. The modified tobacco plant of claim 5, wherein said reduced management comprises reduced manual removal frequency to control suckers, reduced chemical application frequency to control suckers, reduced quantities of chemical application to control suckers, or any combination thereof.

7. The modified tobacco plant of claim 6, wherein said reduced manual removal frequency to control suckers comprises less than 95% as frequently as a control plant when grown under comparable conditions.

8. A tobacco leaf of the modified tobacco plant of claim 1.

9. A tobacco product comprising cured tobacco material from the modified tobacco plant of claim 1.

10. The tobacco product of claim 9, wherein said tobacco product is selected from the group consisting of a cigarette, a kretek, a bidi cigarette, a cigar, a cigarillo, a non-ventilated cigarette, a vented recess filter cigarette, pipe tobacco, snuff, chewing tobacco, moist smokeless tobacco, fine cut chewing tobacco, long cut chewing tobacco, pouched chewing tobacco product, gum, a tablet, a lozenge, and a dissolving strip.

11. A tobacco plant or seed comprising a heterologous recombinant polynucleotide, wherein said recombinant polynucleotide comprises:
   a. an axillary meristem-specific promoter that is functional in a rib zone, a central zone, a peripheral zone, or any combination thereof, and wherein said axillary meristem-specific promoter is operably linked to
   b. a structural nucleic acid molecule comprising a nucleic acid sequence, wherein said nucleic acid sequence encodes a mitogen-activated protein kinase kinase polypeptide at least 95% identical or similar to the amino acid sequence of SEQ ID NO: 233.

12. The tobacco plant or seed of claim 11, wherein said axillary meristem-specific promoter comprises a nucleic acid sequence having at least 95% sequence identity to a polynucleotide selected from the group consisting of SEQ ID NOs: 113, 115-118, 148, 149, 151, 153, 155, 157, 159, and 204.

13. The modified tobacco plant of claim 1, wherein the mitogen-activated protein kinase kinase polypeptide comprises an amino acid sequence 100% identical or similar to SEQ ID NO: 233.

14. The modified tobacco plant of claim 1, wherein the mitogen-activated protein kinase kinase polypeptide is encoded by SEQ ID NO: 232.

15. The tobacco plant or seed of claim 11, wherein the mitogen-activated protein kinase kinase polypeptide comprises an amino acid sequence 100% identical or similar to SEQ ID NO: 233.

16. The tobacco plant or seed of claim 11, wherein the mitogen-activated protein kinase kinase polypeptide is encoded by SEQ ID NO: 232.

17. A leaf of the tobacco plant of claim 11.

18. A tobacco product comprising cured tobacco material from the leaf of claim 17.

19. The tobacco product of claim 18, wherein said tobacco product is selected from the group consisting of a cigarette, a kretek, a bidi cigarette, a cigar, a cigarillo, a non-ventilated cigarette, a vented recess filter cigarette, pipe tobacco, snuff, chewing tobacco, moist smokeless tobacco, fine cut chewing tobacco, long cut chewing tobacco, pouched chewing tobacco product, gum, a tablet, a lozenge, and a dissolving strip.

20. The modified tobacco plant of claim 1, wherein said heterologous axillary meristem-specific promoter comprises a nucleic acid sequence selected from the group consisting of SEQ ID NOs: 113, 115-118, 148, 149, 151, 153, 155, 157, 159, and 204.

* * * * *